United States Patent
Xiao et al.

(10) Patent No.: US 10,918,667 B2
(45) Date of Patent: Feb. 16, 2021

(54) MODIFIED CELL EXPRESSING THERAPEUTIC AGENT AND USES THEREOF

(71) Applicant: Innovative Cellular Therapeutics Co., Ltd., Shanghai (CN)

(72) Inventors: Lei Xiao, Shanghai (CN); Chengfei Pu, Shanghai (CN); Zhiyuan Cao, Shanghai (CN)

(73) Assignee: Innovative Cellular Therapeutics Co., Ltd., Shanghai (CN)

( * ) Notice: Subject to any disclaimer, the term of this patent is extended or adjusted under 35 U.S.C. 154(b) by 0 days.

(21) Appl. No.: 16/445,965

(22) Filed: Jun. 19, 2019

(65) Prior Publication Data

US 2020/0155598 A1 May 21, 2020

Related U.S. Application Data

(60) Provisional application No. 62/848,961, filed on May 16, 2019, provisional application No. 62/846,563, filed on May 10, 2019, provisional application No. 62/828,770, filed on Apr. 3, 2019, provisional application No. 62/795,810, filed on Jan. 23, 2019, provisional application No. 62/774,595, filed on Dec. 3, 2018, provisional application No. 62/769,987, filed on Nov. 20, 2018.

(51) Int. Cl.
| | |
|---|---|
| *A61K 35/17* | (2015.01) |
| *C07K 14/54* | (2006.01) |
| *C07K 14/57* | (2006.01) |
| *C07K 14/705* | (2006.01) |
| *C07K 14/725* | (2006.01) |
| *C07K 16/28* | (2006.01) |
| *A61K 39/00* | (2006.01) |

(52) U.S. Cl.
CPC .......... *A61K 35/17* (2013.01); *C07K 14/5412* (2013.01); *C07K 14/57* (2013.01); *C07K 14/7051* (2013.01); *C07K 14/70521* (2013.01); *C07K 14/70578* (2013.01); *C07K 16/2803* (2013.01); *A61K 2039/505* (2013.01); *C07K 2317/622* (2013.01); *C07K 2319/02* (2013.01); *C07K 2319/03* (2013.01); *C07K 2319/30* (2013.01); *C07K 2319/33* (2013.01)

(58) Field of Classification Search
CPC .... A61K 35/17; C07K 14/5412; C07K 14/57; C07K 14/70521; C07K 14/7051; C07K 14/70578; C07K 16/2803; C07K 2317/622; C07K 2319/33; C07K 2319/30
See application file for complete search history.

(56) References Cited

U.S. PATENT DOCUMENTS

| | | | |
|---|---|---|---|
| 9,388,237 B2 | 7/2016 | Govindan | |
| 9,572,837 B2 | 2/2017 | Wu | |
| 9,932,405 B2 | 4/2018 | Xiao et al. | |
| 2002/0052027 A1 | 5/2002 | Chen et al. | |
| 2002/0192183 A1 | 12/2002 | Jensen | |
| 2005/0079170 A1 | 4/2005 | Le Gall et al. | |
| 2013/0287748 A1 | 10/2013 | June et al. | |
| 2014/0050708 A1 | 2/2014 | Powell et al. | |
| 2014/0227237 A1 | 8/2014 | June et al. | |
| 2014/0271635 A1 | 9/2014 | Brogdon et al. | |
| 2015/0038684 A1 | 2/2015 | Jensen | |
| 2016/0024175 A1 | 1/2016 | Chow et al. | |
| 2016/0250258 A1 | 9/2016 | Delaney et al. | |
| 2016/0256488 A1 | 9/2016 | Wu | |
| 2017/0015746 A1 | 1/2017 | Jensen | |
| 2017/0096638 A1 | 4/2017 | Wu | |
| 2017/0136063 A1 | 5/2017 | Perez et al. | |
| 2017/0145108 A1 | 5/2017 | Schreiber et al. | |
| 2017/0209492 A1 | 7/2017 | June et al. | |
| 2017/0218337 A1 | 8/2017 | Friedman | |
| 2017/0224798 A1 | 8/2017 | Cooper et al. | |
| 2017/0319638 A1 | 11/2017 | Conner et al. | |
| 2017/0335281 A1* | 11/2017 | Loew | A61K 39/0011 |
| 2017/0368098 A1 | 12/2017 | Chen et al. | |
| 2018/0028631 A1 | 2/2018 | Chen | |
| 2018/0153977 A1 | 6/2018 | Wu et al. | |
| 2018/0179289 A1 | 6/2018 | Xiao et al. | |
| 2018/0222995 A1 | 8/2018 | Xiao et al. | |
| 2018/0223255 A1 | 8/2018 | Wu et al. | |
| 2018/0243340 A1 | 8/2018 | Varadarajan et al. | |

(Continued)

FOREIGN PATENT DOCUMENTS

| | | |
|---|---|---|
| WO | WO2008131445 | 10/2008 |
| WO | WO2012050374 | 4/2012 |

(Continued)

OTHER PUBLICATIONS

Fang et al.; Nat. Biotech 2005, 23(5)584-590) (Year: 2005).*

(Continued)

*Primary Examiner* — James D Schultz

(74) *Attorney, Agent, or Firm* — Lee & Hayes, P.C.

(57) ABSTRACT

Compositions and methods for enhancing T cell response which increases the efficacy of CAR T cell therapy for treating cancer are described. Embodiments include a modified cell comprising an isolated nucleic acid comprising a first nucleic acid and a second nucleic acid, the first nucleic acid encoding a chimeric antigen receptor (CAR), the second nucleic acid encoding a therapeutic agent comprising at least one of IFN-γ, IL-2, IL-6, IL-7, IL-15, IL-17, and IL-23. The modified cell expresses and secretes the therapeutic agent.

14 Claims, 30 Drawing Sheets

Specification includes a Sequence Listing.

(56) References Cited

U.S. PATENT DOCUMENTS

| | | |
|---|---|---|
| 2018/0346876 A1 | 12/2018 | Xiao et al. |
| 2019/0000878 A1 | 1/2019 | Xiao et al. |
| 2019/0216851 A1 | 7/2019 | Xiao et al. |
| 2019/0314411 A1 | 10/2019 | Xiao et al. |

FOREIGN PATENT DOCUMENTS

| | | |
|---|---|---|
| WO | WO2012079000 A1 | 6/2012 |
| WO | WO2014011984 | 1/2014 |
| WO | WO2016-070136 | 5/2016 |
| WO | WO2016113203 | 7/2016 |
| WO | WO2016210293 | 12/2016 |
| WO | WO2017027291 A1 | 2/2017 |
| WO | WO2017050884 | 3/2017 |
| WO | WO2017040324 | 9/2017 |
| WO | WO2017149515 | 9/2017 |
| WO | WO2017172981 | 10/2017 |
| WO | WO2017173403 A1 | 10/2017 |
| WO | WO2017177137 | 10/2017 |
| WO | WO2018013918 | 1/2018 |
| WO | WO2018018958 | 2/2018 |
| WO | WO2018049418 | 3/2018 |
| WO | WO2018067697 | 4/2018 |
| WO | WO/2018/106732 * | 6/2018 |
| WO | WO2018111763 A1 | 6/2018 |
| WO | WO2019091478 | 5/2019 |

OTHER PUBLICATIONS

Chen, et al., "CAR T-cell intrinsic PD-1 checkpoint blockade: a two-in-one approach for solid tumor immunotherapy," Feb. 2017, OncoImmunology, 6:2, e1273302, DOI: 10.1080/2162402X.2016.1273302. 4 pages.

Jernberg-Wiklund, et al., "Recombinant interferon-gamma inhibits the growth of IL-6-dependent human multiple myeloma cell lines in vitro," 1991. Eur J Haematol, 46:231.239.

The PCT Search Report and Written Opinion dated Feb. 20, 2020 for PCT Application No. PCT/US19/62417, 14 pages.

Takahashi, et al, "Expression of MUC1 on myeloma cells and induction of HJLA-unrestricted CTL against MUC1 from a multiple myeloma patient," 1994. J Immunol, 153:2102-2109.

Wilkie, et al. "Retargeting of human T cells to tumor-associated MUC1: The evolution of a chimeric antigen receptor," 2008, J. Immunol., 180:4901-4909.

Extended European Search Report dated Nov. 25, 2019 in EP Application No. 19180127.3, Xiao et al., a corresponding foreign application of U.S. Appl. No. 16/146,218, 11 pages.

Lee et al., "T cells expressing CD19 chimeric antigen receptors for acute lymphoblastic leukemia in children and young adults: a phase 1 dose-escalation trial," Oct. 2014. The Lancet, 385(9967): 517-528.

Maude et al., "Chimeric antigen receptor T cells for sustained remissions in leukemia," Oct. 2014. N Engl J Med. 371(16): 1507-1517.

Milone, et al., "Chimeric receptors containing CD137 signal transduction domains mediate enhanced survival of T cells and increased antileukemic efficacy in vivo," Apr. 2009. Molecular Therapy, 17(8): 1453-1464.

Partial European Search Report dated Nov. 4, 2019 in EP Application No. 19180127.3, Xiao et al., a corresponding foreign application of U.S. Appl. No. 16/146,218, 18 pages.

The PCT Search Report and Written Opinion dated Jun. 17, 2019 for PCT Application No. PCT/US19/13068, 14 pages.

Qin et al., "Incorporation of a hinge domain improves the expansion of chimeric antigen receptor T cells," 2017, Journal of Hematology & Oncology, 10:68, 11 pages.

You et al., "Phase 1 clinical trial demonstrated that MUC1 positive metastatic seminal vesicle cancer can be effectively eradicated y modified Anti-MUC1 chimeric antigen receptor transduced T cells", Apr. 2016, Science China: Life Sciences, 59(4): 386-397.

PCT Search Report and Written Opinion dated Jun. 4, 2020 for PCT Application No. PCT/US2020/013099, Xiao et al., 13 pages.

Sahm et al, "Expression of IL-15 in NK Cells Results in Rapid Enrichment and Selective Cytotoxicity of Gene-Modified Effectors That Carry a Tumor-Specific Antigen Receptor," Sep. 2012, Cancer Immunol Immunother, 61(9): 1451-1461.

PCT Communication Invitation to Pay Fees dated Mar. 30, 2020 for PCT Application No. PCT/US20/13099, "Modified Cell Expansion and Uses Thereof", 2 pages.

* cited by examiner

PET/CT Images

TSHR CAR T and CAR 19 CAR T cells were infused on day 0.

Red arrows refer to the sites of tumors 29 days after the infusion, the right tumor disappeared, and the size of the left tumor reduced

FIG. 16

| Date | CAR Copy Number Per ug | 19CAR Copy Number Per ug | 19 CAR/ Total CAR Per ug | CD19% | CD19 Absolute number (10E4/l) | hCAR/ CD3 | CD3% | CD8/CD4 |
|---|---|---|---|---|---|---|---|---|
| 0410-20min | | | | | | | | |
| 0410-2h | | | | 0.445% | 0 | 3.06% | 1.29% | 0.12 |
| 0411 | 113 | UD | | 0.690% | 0 | | 1.37% | 0.27 |
| 0412-1 | 167 | UD | | 0.950% | 2132.1 | 14.98% | 2.18% | 0.38 |
| 0412-2 | 7522 | 4344 | 0.57 | 2.660% | 978.5 | 14.00% | 12.24% | 0.73 |
| 0413 | 422 | UD | | 0.620% | 0 | 14.00% | 5.98% | 0.98 |
| 0414-1 | 2800 | 587 | 0.21 | 0.166% | 521.24 | 14.04% | 15.75% | 0.89 |
| 0414-2 | 3437 | 1293 | 0.38 | 0.230% | 97.94 | 15.23% | 18.85% | 2.03 |
| 0415-1 | 4822 | 2027 | 0.42 | 0.009% | 12.06 | 17.85% | 16.46% | 0.91 |
| 0415-2 | 5760 | 3058 | 0.53 | 0.028% | 0 | 17.06% | 24.10% | 2.56 |
| 0416-1 | 8500 | 3827 | 0.45 | 0.000% | 0 | 22.40% | 15.21% | 1.20 |
| 0416-2 | 9215 | 4219 | 0.46 | 0.000% | 0 | 23.91% | 11.86% | 1.68 |
| 0417-1 | 32476 | 26035 | 0.80 | 0.000% | 0 | 7.77% | 25.86% | 2.13 |
| 0417-2 | 19430 | 12943 | 0.67 | 0.000% | 0 | 24.71% | 11.92% | 3.92 |
| 0418 | 41296 | 24537 | 0.59 | 0.000% | 0 | 15.92% | 57.71% | 3.86 |
| 0419-1 | 52942 | 36730 | 0.69 | 0.000% | 0 | 17.33% | 66.46% | 5.84 |
| 0419-2 | 17525 | 10900 | 0.63 | 0.000% | 0 | 13.90% | 37.67% | 3.05 |
| 0420 | 35627 | 19296 | 0.54 | 0.000% | 0 | 25.64% | 42.68% | 9.58 |
| 0421 | 45922 | 23767 | 0.54 | 0.000% | 0 | 9.22% | 34.23% | 9.22 |
| 0422 | 21942 | 16051 | 0.73 | 0.000% | 0 | 14.92% | 40.55% | 5.59 |
| 0423 | 17042 | 14366 | 0.84 | 0.000% | 0 | 19.93% | 43.96% | 5.95 |
| 0424-1 | 24317 | 13662 | 0.56 | 0.000% | 0 | 12.36% | 41.66% | 4.33 |
| 0424-2 | 13401 | 6191 | 0.46 | 0.000% | 0 | 14.66% | 8.84% | 5.29 |
| 0425 | 14405 | 8881 | 0.61 | 0.000% | 0 | 13.25% | 23.20% | 3.48 |
| 0426 | 7347 | 3924 | 0.53 | 0.000% | 0 | 6.66% | 36.61% | 2.01 |
| 0428 | 41506 | 17245 | 0.42 | 0.000% | 0 | 4.75% | 35.77% | 1.26 |
| 0501 | 8550 | 2449 | 0.29 | 0.000% | 0 | 11.46% | 13.15% | 1.44 |
| 0508 | 1103 | 126 | 0.11 | 0.000% | 0 | 4.84% | 32.72% | 3.84 |

Infusion Date →

MODIFIED CELL EXPRESSING THERAPEUTIC AGENT AND USES THEREOF

CROSS REFERENCE TO RELATED PATENT APPLICATIONS

This application claims the benefit of U.S. Provisional Application No. 62/848,961 filed May 16, 2019, entitled "Modified Cell Expressing Therapeutic Agent and Uses thereof," U.S. Provisional Application No. 62/846,563 filed May 10, 2019, entitled "Modified Cell Expressing Therapeutic Agent and Uses thereof," U.S. Provisional Application No. 62/828,770 filed Apr. 3, 2019, "Chimeric Antigen Receptor Cell Expressing Therapeutic Agent and Uses thereof," U.S. Provisional Application No. 62/795,810 filed Jan. 23, 2019, entitled "Chimeric Antigen Receptor Cell Expressing Therapeutic Agent and Uses thereof," U.S. Provisional Application No. 62/774,595 filed Dec. 3, 2018, entitled "Chimeric Antigen Receptor Cell Expressing Therapeutic Agent and Uses thereof," and U.S. Provisional Application No. 62/769,987 filed Nov. 20, 2018, entitled "Chimeric Antigen Receptor Cell Expressing Therapeutic Agent and Uses thereof," which are hereby incorporated herein by reference in their entirety.

SEQUENCE LISTING INFORMATION

A computer readable textfile, entitled "Sequence Listing_ST25.txt," created on or about Aug. 7, 2020 with a file size of about 1.18 MB, contains the sequence listing for this application and is hereby incorporated by reference in its entirety.

TECHNICAL FIELD

The present disclosure relates to compositions and methods related to chimeric antigen receptor cell secreting therapeutic agent, and uses thereof in the treatment of diseases, including cancer.

BACKGROUND

Cancer involves abnormal cell growth with the potential to invade or spread to other parts of the body. In humans, there are more than one hundred types of cancer. One example is breast cancer occurring in the epithelial tissue of the breast. Since breast cancer cells lose the characteristics of normal cells, the connection between breast cancer cells is lost. Once cancer cells are exfoliated, they spread over the entire body via the blood and/or lymph systems and therefore become life-threatening. Currently, breast cancer has become one of the common threats to women's physical and mental health. Although immunotherapy, for example CAR T cell therapy, has been proven to be effective for treating cancer, there is still a need to improve such immunotherapy so that it is more effective for certain cancers such as those involving solid tumors.

SUMMARY

The present disclosure describes compositions and methods for enhancing T cell response. The present disclosure also describes cells comprising a nucleic acid and an additional nucleic acid, the nucleic acid encoding a chimeric antigen receptor (CAR), the additional nucleic acid encoding a therapeutic agent comprising at least one of IFN-γ, IL-2, IL-6, IL-7, IL-15, IL-17, and IL-23. The cells express and secrete the therapeutic agent.

This Summary is not intended to identify key features or essential features of the claimed subject matter, nor is it intended to be used to limit the scope of the claimed subject matter.

BRIEF DESCRIPTION OF THE DRAWINGS

The Detailed Description is described with reference to the accompanying figures. The use of the same reference numbers in different figures indicates similar or identical items.

FIG. 16 shows various parameters of the patient in response to CAR T cell infusion in a patient.

DETAILED DESCRIPTION

Figure 1:
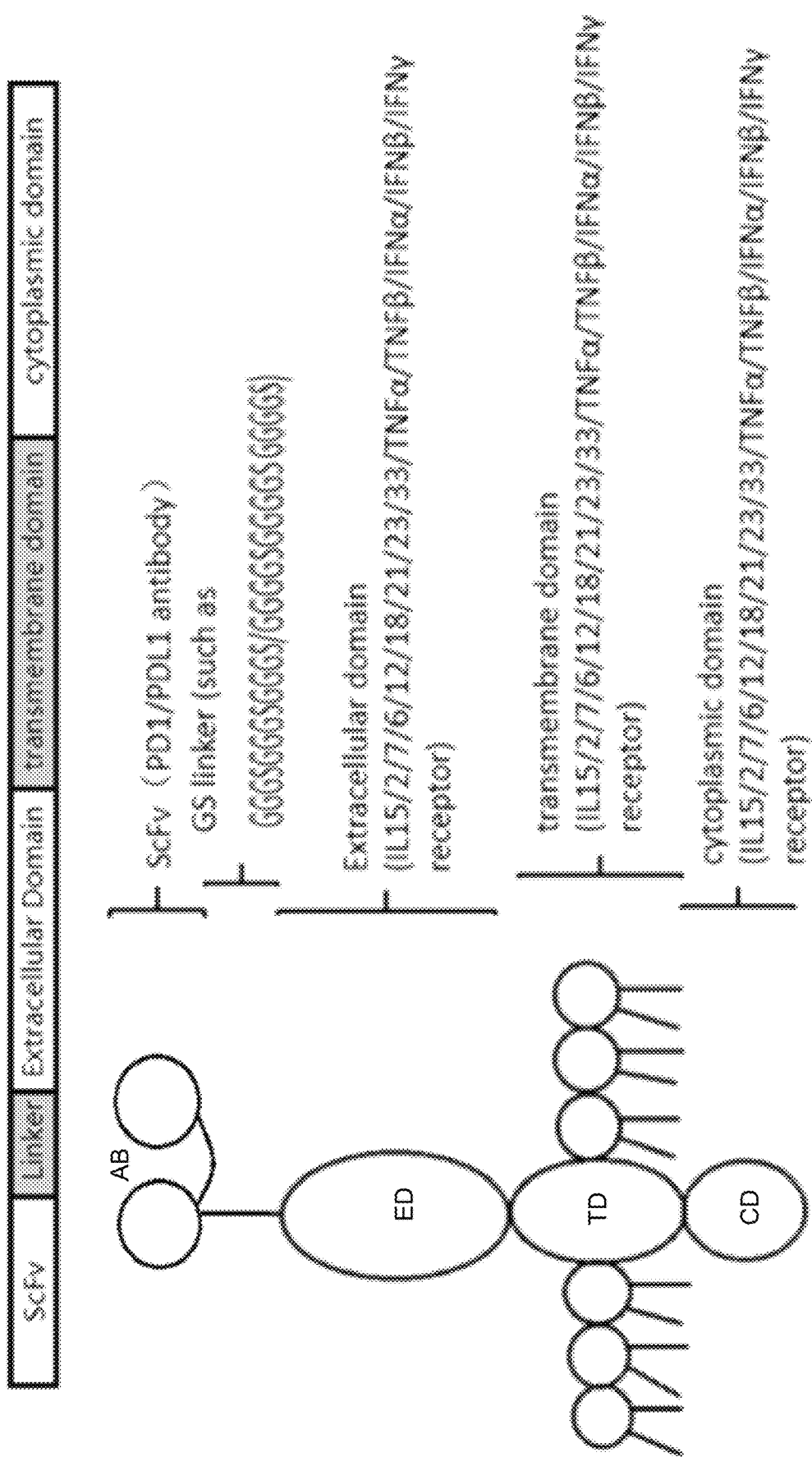
FIG. 1 is a schematic diagram of an exemplary fusion protein including GS linkers as set forth in SEQ ID NO: 470 and SEQ ID NO: 124.
Figure 2:
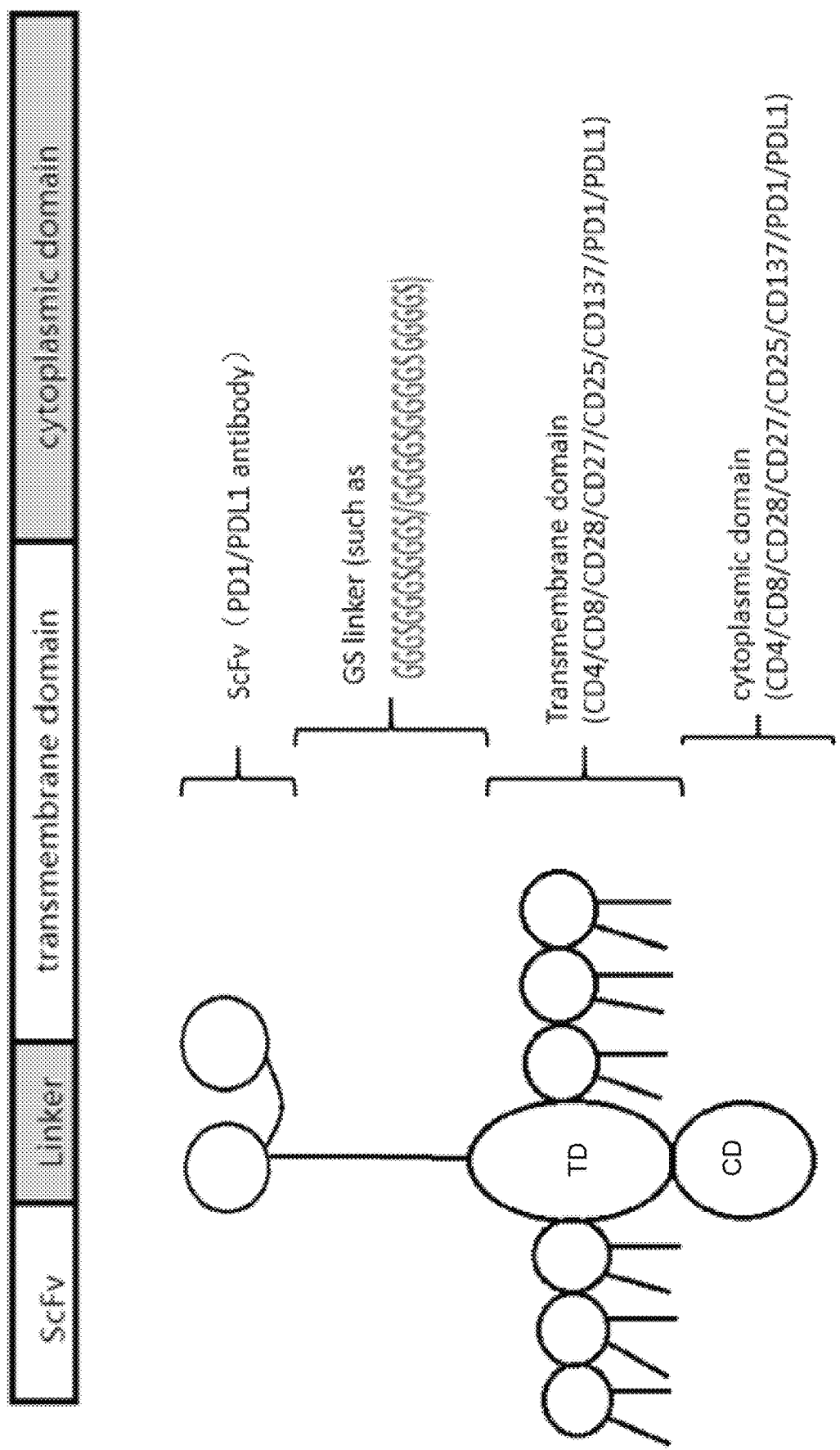
FIG. 2 is a schematic diagram of another exemplary fusion protein including GS linkers as set forth in SEQ ID NO: 470 and SEQ ID NO: 124.
Figure 3:
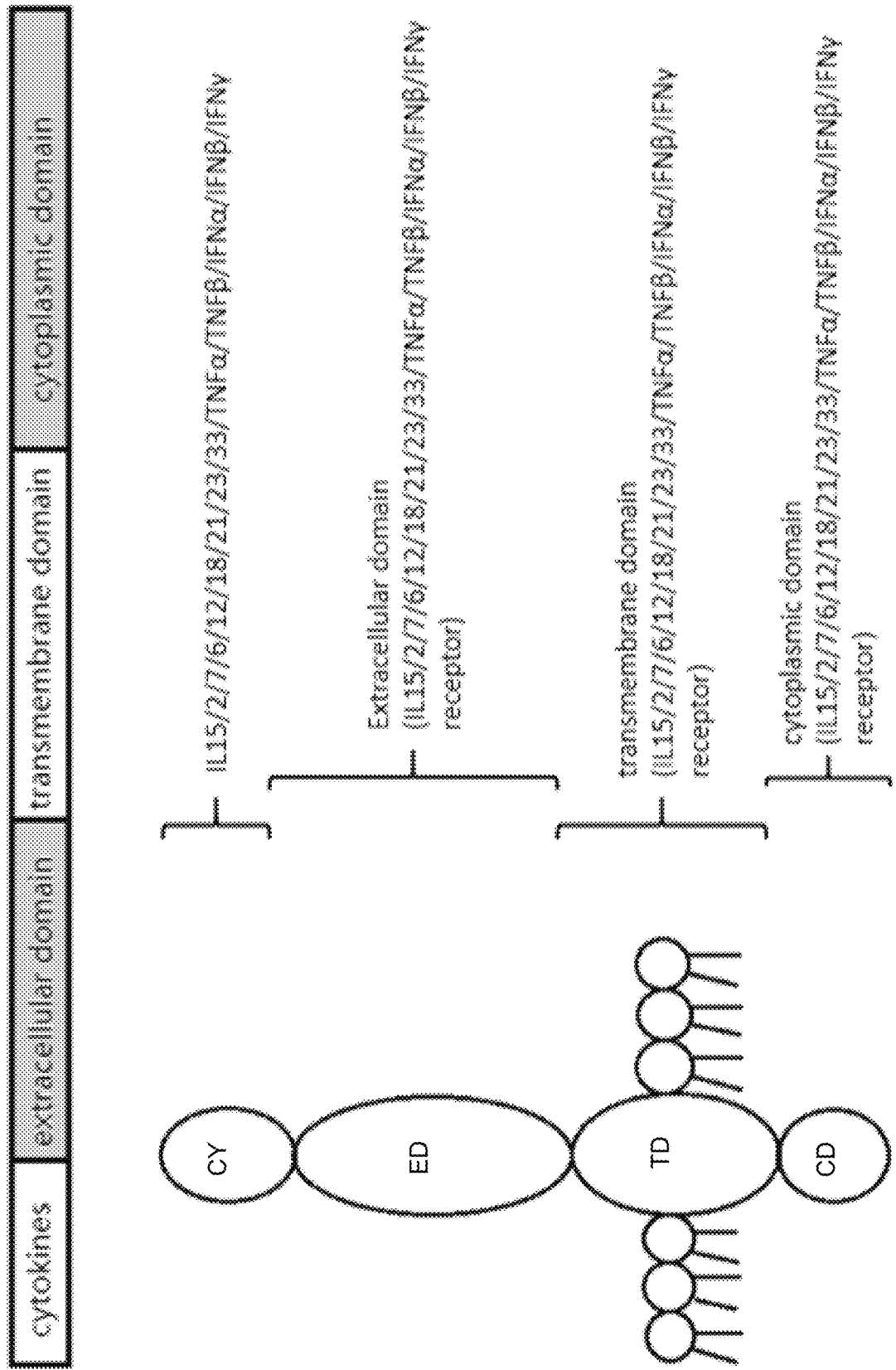
FIG. 3 is a schematic diagram of yet another exemplary fusion protein.
Figure 4:
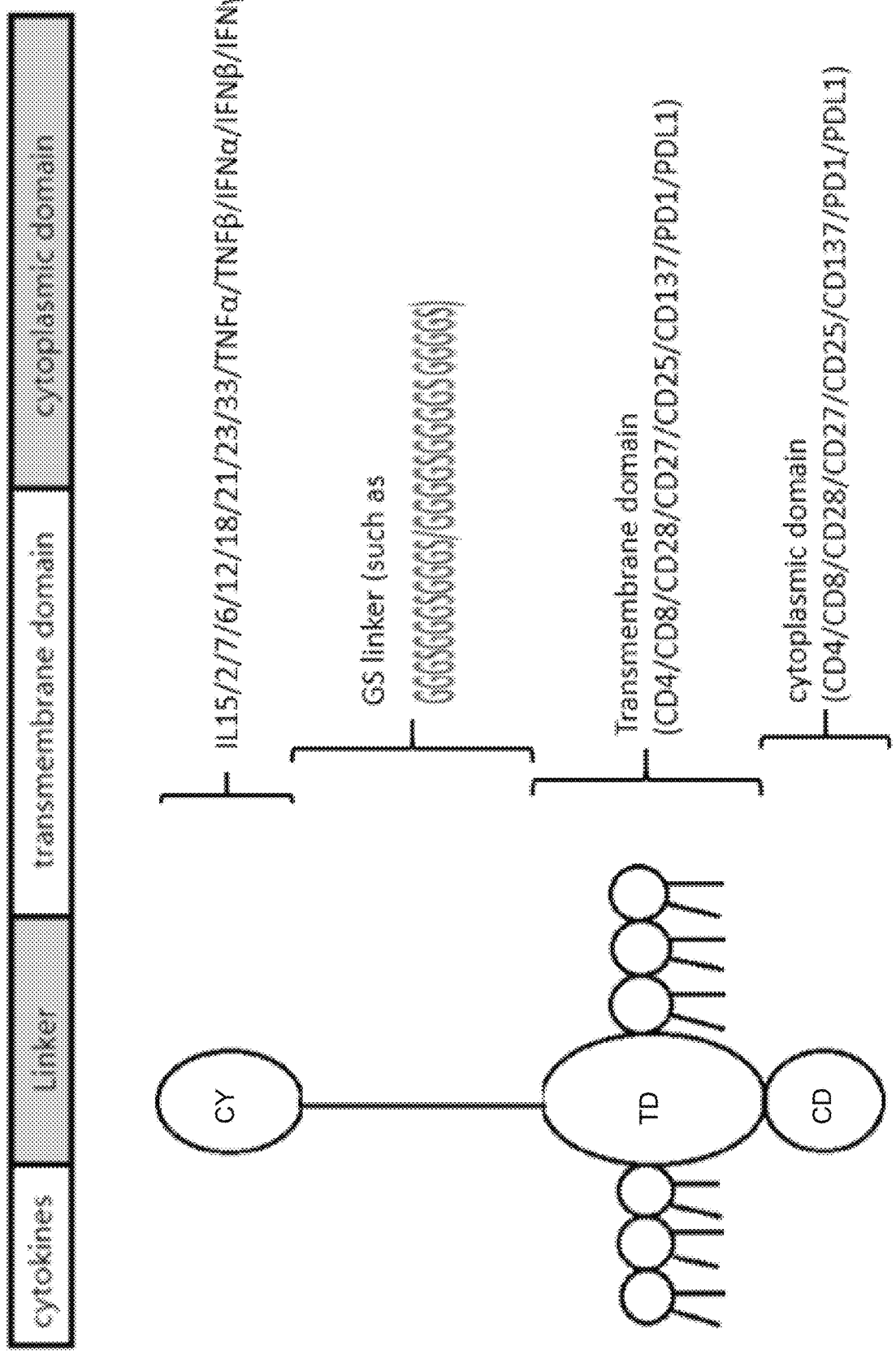
FIG. 4 is a schematic diagram of yet another exemplary fusion protein including GS linkers as set forth in SEQ ID NO: 470 and SEQ ID NO: 124.

Unless defined otherwise, all technical and scientific terms used herein have the same meaning as commonly understood by those of ordinary skill in the art to which the disclosure belongs. Although any method and material similar or equivalent to those described herein can be used in the practice or testing of the present disclosure, preferred methods and materials are described. For the purposes of the present disclosure, the following terms are defined below.

The articles "a" and "an" are used herein to refer to one or to more than one (i.e., to at least one) of the grammatical object of the article. By way of example, "an element" means one element or more than one element.

By "about" is meant a quantity, level, value, number, frequency, percentage, dimension, size, amount, weight or length that varies by as much as 20, 15, 10, 9, 8, 7, 6, 5, 4, 3, 2 or 1% to a reference quantity, level, value, number, frequency, percentage, dimension, size, amount, weight or length.

The term "activation," as used herein, refers to the state of a cell that has been sufficiently stimulated to induce detectable cellular proliferation. Activation can also be associated with induced cytokine production and detectable effector functions. The term "activated T cells" refers to, among other things, T cells that are undergoing cell division.

The term "antibody" is used in the broadest sense and refers to monoclonal antibodies (including full length monoclonal antibodies), polyclonal antibodies, multi-specific antibodies (e.g., bispecific antibodies), and antibody fragments so long as they exhibit the desired biological activity or function. The antibodies in the present disclosure may exist in a variety of forms including, for example, polyclonal antibodies; monoclonal antibodies; Fv, Fab, Fab', and F(ab)$_2$ and fragments; as well as single chain antibodies and humanized antibodies (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, N.Y.; Houston et al., 1988, Proc. Natl. Acad. Sci. USA 85:5879-5883; Bird et al., 1988, Science 242:423-426).

The term "antibody fragments" refers to a portion of a full-length antibody, for example, the antigen binding or variable region of the antibody. Other examples of antibody fragments include Fab, Fab', F(ab')2, and Fv fragments; diabodies; linear antibodies; single-chain antibody molecules; and multi-specific antibodies formed from antibody fragments.

The term "Fv" refers to the minimum antibody fragment which contains a complete antigen-recognition and -binding site. This fragment consists of a dimer of one heavy- and one light-chain variable region domain in tight, non-covalent association. From the folding of these two domains emanates six hypervariable loops (3 loops each from the H and L chain) that contribute amino acid residues for antigen binding and confer antigen binding specificity to the antibody. However, even a single variable domain (or half of an Fv including only three complementarity determining regions (CDRs) specific for an antigen) has the ability to recognize and bind antigen, although at a lower affinity than the entire binding site (the dimer).

An "antibody heavy chain," as used herein, refers to the larger of the two types of polypeptide chains present in all antibody molecules in their naturally occurring conformations. An "antibody light chain," as used herein, refers to the smaller of the two types of polypeptide chains present in all antibody molecules in their naturally occurring conformations. κ and λ light chains refer to the two major antibody light chain isotypes.

The term "synthetic antibody" refers to an antibody which is generated using recombinant DNA technology, such as, for example, an antibody expressed by a bacteriophage. The term also includes an antibody which has been generated by the synthesis of a DNA molecule encoding the antibody and the expression of the DNA molecule to obtain the antibody or to obtain an amino acid encoding the antibody. The synthetic DNA is obtained using technology that is available and well known in the art.

The term "antigen" refers to a molecule that provokes an immune response, which may involve either antibody production, or the activation of specific immunologically-competent cells, or both. Antigens include any macromolecule, including all proteins or peptides, or molecules derived from recombinant or genomic DNA. For example, DNA including a nucleotide sequence or a partial nucleotide sequence encoding a protein or peptide that elicits an immune response, and therefore, encodes an "antigen" as the term is used herein. An antigen need not be encoded solely by a full-length nucleotide sequence of a gene. An antigen can be generated, synthesized or derived from a biological sample including a tissue sample, a tumor sample, a cell, or a biological fluid.

The term "anti-tumor effect" as used herein, refers to a biological effect associated with a decrease in tumor volume, a decrease in the number of tumor cells, a decrease in the number of metastases, decrease in tumor cell proliferation, decrease in tumor cell survival, an increase in life expectancy of a subject having tumor cells, or amelioration of various physiological symptoms associated with the cancerous condition. An "anti-tumor effect" can also be manifested by the ability of the peptides, polynucleotides, cells, and antibodies in the prevention of the occurrence of tumor in the first place.

The term "auto-antigen" refers to an endogenous antigen mistakenly recognized by the immune system as being foreign. Auto-antigens include cellular proteins, phosphoproteins, cellular surface proteins, cellular lipids, nucleic acids, glycoproteins, including cell surface receptors.

The term "autologous" is used to describe a material derived from a subject which is subsequently re-introduced into the same subject.

The term "allogeneic" is used to describe a graft derived from a different subject of the same species. As an example, a donor subject may be a related or unrelated or recipient subject, but the donor subject has immune system markers which are similar to the recipient subject.

The term "xenogeneic" is used to describe a graft derived from a subject of a different species. As an example, the donor subject is from a different species than a recipient subject, and the donor subject and the recipient subject can be genetically and immunologically incompatible.

The term "cancer" is used to refer to a disease characterized by the rapid and uncontrolled growth of aberrant cells. Cancer cells can spread locally or through the bloodstream and lymphatic system to other parts of the body. Examples of various cancers include breast cancer, prostate cancer, ovarian cancer, cervical cancer, skin cancer, pancreatic cancer, colorectal cancer, renal cancer, liver cancer, brain cancer, lymphoma, leukemia, lung cancer, and the like.

Throughout this specification, unless the context requires otherwise, the words "comprise," "includes" and "including" will be understood to imply the inclusion of a stated step or element or group of steps or elements but not the exclusion of any other step or element or group of steps or elements.

The phrase "consisting of" is meant to include, and is limited to, whatever follows the phrase "consisting of." Thus, the phrase "consisting of" indicates that the listed elements are required or mandatory and that no other elements may be present.

The phrase "consisting essentially of" is meant to include any element listed after the phrase and can include other elements that do not interfere with or contribute to the activity or action specified in the disclosure for the listed elements. Thus, the phrase "consisting essentially of" indicates that the listed elements are required or mandatory, but that other elements are optional and may or may not be present depending upon whether or not they affect the activity or action of the listed elements.

The terms "complementary" and "complementarity" refer to polynucleotides (i.e., a sequence of nucleotides) related by the base-pairing rules. For example, the sequence "A-G-T," is complementary to the sequence "T-C-A." Complementarity may be "partial," in which only some of the nucleic acids' bases are matched according to the base pairing rules, or there may be "complete" or "total" complementarity between the nucleic acids. The degree of complementarity between nucleic acid strands has significant effects on the efficiency and strength of hybridization between nucleic acid strands.

The term "corresponds to" or "corresponding to" refers to (a) a polynucleotide having a nucleotide sequence that is substantially identical or complementary to all or a portion of a reference polynucleotide sequence or encoding an amino acid sequence identical to an amino acid sequence in a peptide or protein; or (b) a peptide or polypeptide having an amino acid sequence that is substantially identical to a sequence of amino acids in a reference peptide or protein.

The term "co-stimulatory ligand," refers to a molecule on an antigen presenting cell (e.g., an APC, dendritic cell, B cell, and the like) that specifically binds a cognate co-stimulatory molecule on a T cell, thereby providing a signal which, in addition to the primary signal provided by, for instance, binding of a TCR/CD3 complex with an MHC molecule loaded with peptide, mediates a T cell response, including at least one of proliferation, activation, differentiation, and other cellular responses. A co-stimulatory ligand can include B7-1 (CD80), B7-2 (CD86), PD-L1, PD-L2, 4-1BBL, OX40L, inducible co-stimulatory ligand (ICOS-L), intercellular adhesion molecule (ICAM), CD30L, CD40, CD70, CD83, HLA-G, MICA, MICB, HVEM, lymphotoxin beta receptor, 3/TR6, ILT3, ILT4, HVEM, a ligand for CD7, an agonist or antibody that binds the Toll ligand receptor and a ligand that specifically binds with B7-H3. A co-stimulatory ligand also includes, inter alia, an agonist or an antibody that specifically binds with a co-stimulatory molecule present on a T cell, such as CD27, CD28, 4-1BB, OX40, CD30, CD40, PD-1, ICOS, lymphocyte function-associated antigen-1 (LFA-1), CD2, CD7, LIGHT, NKG2C, B7-H3, and a ligand that specifically binds CD83.

The term "co-stimulatory molecule" refers to the cognate binding partner on a T cell that specifically binds with a co-stimulatory ligand, thereby mediating a co-stimulatory response by the T cell, such as proliferation. Co-stimulatory molecules include an MHC class I molecule, BTLA, and a Toll-like receptor.

The term "co-stimulatory signal" refers to a signal, which in combination with a primary signal, such as TCR/CD3 ligation, leads to T cell proliferation and/or upregulation or downregulation of key molecules. The terms "disease" and "condition" may be used interchangeably or may be different in that the particular malady or condition may not have a known causative agent (so that etiology has not yet been worked out), and it is therefore not yet recognized as a disease but only as an undesirable condition or syndrome, wherein a more or less specific set of symptoms have been identified by clinicians. The term "disease" is a state of health of a subject wherein the subject cannot maintain homeostasis, and wherein if the disease is not ameliorated then the subject's health continues to deteriorate. In contrast, a "disorder" in a subject is a state of health in which the animal is able to maintain homeostasis, but in which the animal's state of health is less favorable than it would be in the absence of the disorder. Left untreated, a disorder does not necessarily cause a further decrease in the animal's state of health.

The term "effective" refers to adequate to accomplish a desired, expected, or intended result. For example, an "effective amount" in the context of treatment may be an amount of a compound sufficient to produce a therapeutic or prophylactic benefit.

The term "encoding" refers to the inherent property of specific sequences of nucleotides in a polynucleotide, such as a gene, a cDNA, or an mRNA, to serve as a template for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA corresponding to that gene produces the protein in a cell or other biological system. Both the coding strand, the nucleotide sequence of which is identical to the mRNA sequence (except that a "T" is replaced by a "U") and is usually provided in sequence listings, and the non-coding strand, used as the template for transcription of a gene or cDNA, can be referred to as encoding the protein or other product of that gene or cDNA.

The term "exogenous" refers to a molecule that does not naturally occur in a wild-type cell or organism but is typically introduced into the cell by molecular biological techniques. Examples of exogenous polynucleotides include vectors, plasmids, and/or man-made nucleic acid constructs encoding the desired protein. With regard to polynucleotides and proteins, the term "endogenous" or "native" refers to naturally-occurring polynucleotide or amino acid sequences that may be found in a given wild-type cell or organism. Also, a particular polynucleotide sequence that is isolated from a first organism and transferred to a second organism by molecular biological techniques is typically considered an "exogenous" polynucleotide or amino acid sequence with respect to the second organism. In specific embodiments, polynucleotide sequences can be "introduced" by molecular biological techniques into a microorganism that already contains such a polynucleotide sequence, for instance, to create one or more additional copies of an otherwise naturally-occurring polynucleotide sequence, and thereby facilitate overexpression of the encoded polypeptide.

The term "expression" refers to the transcription and/or translation of a particular nucleotide sequence driven by its promoter.

The term "expression vector" refers to a vector including a recombinant polynucleotide including expression control (regulatory) sequences operably linked to a nucleotide sequence to be expressed. An expression vector includes sufficient cis-acting elements for expression; other elements for expression can be supplied by the host cell or in an in vitro expression system. Expression vectors include all those known in the art, such as cosmids, plasmids (e.g., naked or contained in liposomes) and viruses (e.g., lentiviruses, retroviruses, adenoviruses, and adeno-associated viruses) that incorporate the recombinant polynucleotide.

The term "homologous" refers to sequence similarity or sequence identity between two polypeptides or between two polynucleotides when a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared ×100. For example, if 6 of 10 of the positions in two sequences are matched or homologous, then the two sequences are 60% homologous. By way of example, the DNA sequences ATTGCC and TATGGC share 50% homology. A comparison is made when two sequences are aligned to give maximum homology.

The term "immunoglobulin" or "Ig," refers to a class of proteins, which function as antibodies. The five members included in this class of proteins are IgA, IgG, IgM, IgD, and IgE. IgA is the primary antibody that is present in body secretions, such as saliva, tears, breast milk, gastrointestinal secretions and mucus secretions of the respiratory and genitourinary tracts. IgG is the most common circulating antibody. IgM is the main immunoglobulin produced in the primary immune response in most subjects. It is the most efficient immunoglobulin in agglutination, complement fixation, and other antibody responses, and is important in defense against bacteria and viruses. IgD is the immunoglobulin that has no known antibody function but may serve as an antigen receptor. IgE is the immunoglobulin that mediates immediate hypersensitivity by causing the release of mediators from mast cells and basophils upon exposure to the allergen.

The term "isolated" refers to a material that is substantially or essentially free from components that normally accompany it in its native state. The material can be a cell or a macromolecule such as a protein or nucleic acid. For example, an "isolated polynucleotide," as used herein, refers to a polynucleotide, which has been purified from the sequences which flank it in a naturally-occurring state, e.g., a DNA fragment which has been removed from the sequences that are normally adjacent to the fragment. Alternatively, an "isolated peptide" or an "isolated polypeptide" and the like, as used herein, refer to in vitro isolation and/or purification of a peptide or polypeptide molecule from its natural cellular environment, and from association with other components of the cell.

The term "substantially purified" refers to a material that is substantially free from components that are normally associated with it in its native state. For example, a substantially purified cell refers to a cell that has been separated from other cell types with which it is normally associated in its naturally occurring or native state. In some instances, a population of substantially purified cells refers to a homogenous population of cells. In other instances, this term refers simply to a cell that has been separated from the cells with which they are naturally associated in their natural state. In embodiments, the cells are cultured in vitro. In embodiments, the cells are not cultured in vitro.

In the context of the present disclosure, the following abbreviations for the commonly occurring nucleic acid bases are used. "A" refers to adenosine, "C" refers to cytosine, "G" refers to guanosine, "T" refers to thymidine, and "U" refers to uridine.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or an RNA may also include introns to the extent that the nucleotide sequence encoding the protein may in some version contain an intron(s).

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. Moreover, the use of lentiviruses enables integration of the genetic information into the host chromosome resulting in stably transduced genetic information. HIV, SIV, and FIV are all examples of lentiviruses. Vectors derived from lentiviruses offer the means to achieve significant levels of gene transfer in vivo.

The term "modulating," refers to mediating a detectable increase or decrease in the level of a response in a subject compared with the level of a response in the subject in the absence of a treatment or compound, and/or compared with the level of a response in an otherwise identical but untreated subject. The term encompasses perturbing and/or affecting a native signal or response thereby mediating a beneficial therapeutic response in a subject, preferably, a human.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation.

The term "under transcriptional control" refers to a promoter being operably linked to and in the correct location and orientation in relation to a polynucleotide to control (regulate) the initiation of transcription by RNA polymerase and expression of the polynucleotide.

The term "overexpressed" tumor antigen or "overexpression" of the tumor antigen is intended to indicate an abnormal level of expression of the tumor antigen in a cell from a disease area such as a solid tumor within a specific tissue or organ of the patient relative to the level of expression in a normal cell from that tissue or organ. Patients having solid tumors or a hematological malignancy characterized by overexpression of the tumor antigen can be determined by standard assays known in the art.

Cancers that may be treated include tumors that are not vascularized, or not yet substantially vascularized, as well as vascularized tumors. The cancers may include non-solid tumors (such as hematological tumors, for example, leukemias and lymphomas) or may include solid tumors. Types of cancers to be treated with the CARs of the disclosure include, but are not limited to, carcinoma, blastoma, and sarcoma, and certain leukemia or lymphoid malignancies, benign and malignant tumors, and malignancies, e.g., sarcomas, carcinomas, and melanomas. Adult tumors/cancers and pediatric tumors/cancers are also included.

Hematologic cancers are cancers of the blood or bone marrow. Examples of hematological (or hematogenous)

cancers include leukemias, including acute leukemias (such as acute lymphocytic leukemia, acute myelocytic leukemia, acute myelogenous leukemia and myeloblastic, promyelocytic, myelomonocytic, monocytic and erythroleukemia), chronic leukemias (such as chronic myelocytic (granulocytic) leukemia, chronic myelogenous leukemia, and chronic lymphocytic leukemia), polycythemia vera, lymphoma, Hodgkin's disease, non-Hodgkin's lymphoma (indolent and high grade forms), multiple myeloma, Waldenstrom's macroglobulinemia, heavy chain disease, myelodysplastic syndrome, hairy cell leukemia and myelodysplasia.

Solid tumors are abnormal masses of tissue that usually do not contain cysts or liquid areas. Solid tumors can be benign or malignant. Different types of solid tumors are named for the type of cells that form them (such as sarcomas, carcinomas, and lymphomas). Examples of solid tumors, such as sarcomas and carcinomas, include fibrosarcoma, myxosarcoma, liposarcoma, chondrosarcoma, osteosarcoma, and other sarcomas, synovioma, mesothelioma, Ewing's tumor, leiomyosarcoma, rhabdomyosarcoma, colon carcinoma, lymphoid malignancy, pancreatic cancer, breast cancer, lung cancers, ovarian cancer, prostate cancer, hepatocellular carcinoma, squamous cell carcinoma, basal cell carcinoma, adenocarcinoma, sweat gland carcinoma, medullary thyroid carcinoma, papillary thyroid carcinoma, pheochromocytomas sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, Wilms' tumor, cervical cancer, testicular tumor, seminoma, bladder carcinoma, melanoma, and CNS tumors (such as a glioma (such as brainstem glioma and mixed gliomas), glioblastoma (also known as glioblastoma multiforme), astrocytoma, CNS lymphoma, germinoma, medulloblastoma, Schwannoma craniopharyogioma, ependymoma, pinealoma, hemangioblastoma, acoustic neuroma, oligodendroglioma, menangioma, neuroblastoma, retinoblastoma, and brain metastases).

A solid tumor antigen is an antigen expressed on a solid tumor. In embodiments, solid tumor antigen is also expressed at low levels on healthy tissue. Examples of solid tumor antigens and their related disease tumors are provided in Table 1.

TABLE 1

| Solid Tumor antigen | Disease tumor |
| --- | --- |
| PRLR | Breast Cancer |
| CLCA1 | colorectal Cancer |
| MUC12 | colorectal Cancer |
| GUCY2C | colorectal Cancer |
| GPR35 | colorectal Cancer |
| CR1L | Gastric Cancer |
| MUC 17 | Gastric Cancer |
| TMPRSS11B | esophageal Cancer |
| MUC21 | esophageal Cancer |
| TMPRSS11E | esophageal Cancer |
| CD207 | bladder Cancer |
| SLC30A8 | pancreatic Cancer |
| CFC1 | pancreatic Cancer |
| SLC12A3 | Cervical Cancer |
| SSTR1 | Cervical tumor |
| GPR27 | Ovary tumor |
| FZD10 | Ovary tumor |
| TSHR | Thyroid Tumor |
| SIGLEC15 | Urothelial cancer |
| SLC6A3 | Renal cancer |
| KISS1R | Renal cancer |
| QRFPR | Renal cancer: |
| GPR119 | Pancreatic cancer |

TABLE 1-continued

| Solid Tumor antigen | Disease tumor |
| --- | --- |
| CLDN6 | Endometrial cancer/Urothelial cancer |
| UPK2 | Urothelial cancer (including bladder cancer) |
| ADAM12 | Breast cancer, pancreatic cancer and the like |
| SLC45A3 | Prostate cancer |
| ACPP | Prostate cancer |
| MUC21 | Esophageal cancer |
| MUC16 | Ovarian cancer |
| MS4A12 | Colorectal cancer |
| ALPP | Endometrial cancer |
| CEA | Colorectal carcinoma |
| EphA2 | Glioma |
| FAP | Mesotelioma |
| GPC3 | Lung squamous cell carcinoma |
| IL13-Rα2 | Glioma |
| Mesothelin | Metastatic cancer |
| PSMA | Prostate cancer |
| ROR1 | Breast lung carcinoma |
| VEGFR-II | Metastatic cancer |
| GD2 | Neuroblastoma |
| FR-α | Ovarian carcinoma |
| ErbB2 | Carcinomasb |
| EpCAM | Carcinomasa |
| EGFRvIII | Glioma-Glioblastoma |
| EGFR | Glioma-NSCL cancer |
| tMUC 1 | Cholangiocarcinoma, Pancreatic cancer, Breast Cancer |
| B7-H3 | Ewing sarcoma (bone tumor), rhabdomyosarcoma, nephroblastoma, neuroblastoma and medulloblastoma (brain tumor) |

The term "parenteral administration" of a composition includes, e.g., subcutaneous (s.c.), intravenous (i.v.), intramuscular (i.m.), intrasternal injection, or infusion techniques.

The terms "patient," "subject," and "individual," and the like are used interchangeably herein and refer to any human, or animal, amenable to the methods described herein. In certain non-limiting embodiments, the patient, subject, or individual is a human or animal. In embodiments, the term "subject" is intended to include living organisms in which an immune response can be elicited (e.g., mammals). Examples of subjects include humans, and animals such as dogs, cats, mice, rats, and transgenic species thereof.

A subject in need of treatment or in need thereof includes a subject having a disease, condition, or disorder that needs to be treated. A subject in need thereof also includes a subject that needs treatment for prevention of a disease, condition, or disorder. In embodiments, the disease, condition, or disorder is cancer.

The term "polynucleotide" or "nucleic acid" refers to mRNA, RNA, cRNA, rRNA, cDNA or DNA. The term typically refers to a polymeric form of nucleotides of at least 10 bases in length, either ribonucleotides or deoxynucleotides or a modified form of either type of nucleotide. The term includes all forms of nucleic acids including single and double-stranded forms of nucleic acids.

The terms "polynucleotide variant" and "variant" and the like refer to polynucleotides displaying substantial sequence identity with a reference polynucleotide sequence or polynucleotides that hybridize with a reference sequence under stringent conditions that are defined hereinafter. These terms also encompass polynucleotides that are distinguished from a reference polynucleotide by the addition, deletion or substitution of at least one nucleotide. Accordingly, the terms "polynucleotide variant" and "variant" include polynucleotides in which one or more nucleotides have been added or deleted or replaced with different nucleotides. In this regard, it is well understood in the art that certain alterations inclusive of mutations, additions, deletions, and substitutions can be made to a reference polynucleotide whereby the altered polynucleotide retains the biological function or activity of the reference polynucleotide or has increased activity in relation to the reference polynucleotide (i.e., optimized). Polynucleotide variants include, for example, polynucleotides having at least 50% (and at least 51% to at least 99% and all integer percentages in between, e.g., 90%, 95%, or 98%) sequence identity with a reference polynucleotide sequence described herein. The terms "polynucleotide variant" and "variant" also include naturally-occurring allelic variants and orthologs.

The terms "polypeptide," "polypeptide fragment," "peptide," and "protein" are used interchangeably herein to refer to a polymer of amino acid residues and to variants and synthetic analogues of the same. Thus, these terms apply to amino acid polymers in which one or more amino acid residues are synthetic non-naturally occurring amino acids, such as a chemical analogue of a corresponding naturally occurring amino acid, as well as to naturally-occurring amino acid polymers. In certain aspects, polypeptides may include enzymatic polypeptides, or "enzymes," which typically catalyze (i.e., increase the rate of) various chemical reactions.

The term "polypeptide variant" refers to polypeptides that are distinguished from a reference polypeptide sequence by the addition, deletion, or substitution of at least one amino acid residue. In certain embodiments, a polypeptide variant is distinguished from a reference polypeptide by one or more substitutions, which may be conservative or non-conservative. In certain embodiments, the polypeptide variant comprises conservative substitutions and, in this regard, it is well understood in the art that some amino acids may be changed to others with broadly similar properties without changing the nature of the activity of the polypeptide. Polypeptide variants also encompass polypeptides in which one or more amino acids have been added or deleted or replaced with different amino acid residues.

The term "promoter" refers to a DNA sequence recognized by the synthetic machinery of the cell or introduced synthetic machinery, required to initiate the specific transcription of a polynucleotide sequence. The term "expression control (regulatory) sequences" refers to DNA sequences necessary for the expression of an operably linked coding sequence in a particular host organism. The control (regulatory) sequences that are suitable for prokaryotes, for example, include a promoter, optionally an operator sequence, and a ribosome binding site. Eukaryotic cells are known to utilize promoters, polyadenylation signals, and enhancers.

The term "bind," "binds," or "interacts with" refers to a molecule recognizing and adhering to a second molecule in a sample or organism but does not substantially recognize or adhere to other structurally unrelated molecules in the sample. The term "specifically binds," as used herein with respect to an antibody, refers to an antibody which recognizes a specific antigen, but does not substantially recognize or bind other molecules in a sample. For example, an antibody that specifically binds an antigen from one species may also bind that antigen from one or more species. But, such cross-species reactivity does not itself alter the classification of an antibody as specific. In another example, an antibody that specifically binds an antigen may also bind different allelic forms of the antigen. However, such cross reactivity does not itself alter the classification of an antibody as specific. In some instances, the terms "specific binding" or "specifically binding," can be used in reference to the interaction of an antibody, a protein, or a peptide with a second chemical species, to mean that the interaction is dependent upon the presence of a particular structure (e.g., an antigenic determinant or epitope) on the chemical species; for example, an antibody recognizes and binds a specific protein structure rather than to any protein. If an antibody is specific for epitope "A," the presence of a molecule containing epitope A (or free, unlabeled A), in a reaction containing labeled "A" and the antibody, will reduce the amount of labeled A bound to the antibody.

By "statistically significant," it is meant that the result was unlikely to have occurred by chance. Statistical significance can be determined by any method known in the art. Commonly used measures of significance include the p-value, which is the frequency or probability with which the observed event would occur if the null hypothesis were true. If the obtained p-value is smaller than the significance level, then the null hypothesis is rejected. In simple cases, the significance level is defined at a p-value of 0.5 or less. A "decreased" or "reduced" or "lesser" amount is typically a "statistically significant" or a physiologically significant amount, and may include a decrease that is about 1.1, 1.2, 1.3, 1.4, 1.5, 1.6 1.7, 1.8, 1.9, 2, 2.5, 3, 3.5, 4, 4.5, 5, 6, 7, 8, 9, 10, 15, 20, 30, 40, or 50 or more times (e.g., 100, 500, 1000 times) (including all integers and decimal points in between and above 1, e.g., 1.5, 1.6, 1.7. 1.8, etc.) an amount or level described herein.

The term "stimulation," refers to a primary response induced by binding of a stimulatory molecule (e.g., a TCR/CD3 complex) with its cognate ligand thereby mediating a signal transduction event, such as signal transduction via the TCR/CD3 complex. Stimulation can mediate altered expression of certain molecules, such as downregulation of TGF-$\beta$, and/or reorganization of cytoskeletal structures.

The term "stimulatory molecule" refers to a molecule on a T cell that specifically binds a cognate stimulatory ligand present on an antigen presenting cell. For example, a functional signaling domain derived from a stimulatory molecule is the zeta chain associated with the T cell receptor complex. The stimulatory molecule includes a domain responsible for signal transduction.

The term "stimulatory ligand" refers to a ligand that when present on an antigen presenting cell (e.g., an APC, a dendritic cell, a B-cell, and the like.) can specifically bind with a cognate binding partner (referred to herein as a "stimulatory molecule") on a cell, for example a T cell, thereby mediating a primary response by the T cell, including activation, initiation of an immune response, proliferation, and similar processes. Stimulatory ligands are well-known in the art and encompass, inter alia, an MHC Class I molecule loaded with a peptide, an anti-CD3 antibody, a superagonist anti-CD28 antibody, and a superagonist anti-CD2 antibody.

The term "therapeutic" refers to a treatment and/or prophylaxis. A therapeutic effect is obtained by suppression, remission, or eradication of a disease state or alleviating the symptoms of a disease state.

The term "therapeutically effective amount" refers to the amount of the subject compound that will elicit the biological or medical response of a tissue, system, or subject that is being sought by the researcher, veterinarian, medical doctor or another clinician. The term "therapeutically effective amount" includes that amount of a compound that, when administered, is sufficient to prevent the development of, or alleviate to some extent, one or more of the signs or symptoms of the disorder or disease being treated. The therapeutically effective amount will vary depending on the compound, the disease and its severity and the age, weight, etc., of the subject to be treated.

The term "treat a disease" refers to the reduction of the frequency or severity of at least one sign or symptom of a disease or disorder experienced by a subject.

The term "transfected" or "transformed" or "transduced" refers to a process by which an exogenous nucleic acid is transferred or introduced into the host cell. A "transfected" or "transformed" or "transduced" cell is one which has been transfected, transformed, or transduced with exogenous nucleic acid. The cell includes the primary subject cell and its progeny.

The term "vector" refers to a polynucleotide that comprises an isolated nucleic acid and which can be used to deliver the isolated nucleic acid to the interior of a cell. Numerous vectors are known in the art including linear polynucleotides, polynucleotides associated with ionic or amphiphilic compounds, plasmids, and viruses. Thus, the term "vector" includes an autonomously replicating plasmid or a virus. The term also includes non-plasmid and non-viral compounds which facilitate the transfer of nucleic acid into cells, such as, for example, polylysine compounds, liposomes, and the like. Examples of viral vectors include adenoviral vectors, adeno-associated virus vectors, retroviral vectors, and others. For example, lentiviruses are complex retroviruses, which, in addition to the common retroviral genes gag, pol, and env, contain other genes with regulatory or structural function. Lentiviral vectors are well known in the art. Some examples of lentivirus include the Human Immunodeficiency Viruses: HIV-1, HIV-2, and the Simian Immunodeficiency Virus: SIV. Lentiviral vectors have been generated by multiply attenuating the HIV virulence genes, for example, the genes env, vif, vpr, vpu, and nef are deleted making the vector biologically safe.

Ranges: throughout this disclosure, various aspects of the disclosure can be presented in a range format. It should be understood that the description in range format is merely for convenience and brevity and should not be construed as an inflexible limitation on the scope of the disclosure. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. This applies regardless of the breadth of the range.

A "chimeric antigen receptor" (CAR) molecule is a recombinant polypeptide including at least an extracellular domain, a transmembrane domain and a cytoplasmic domain or intracellular domain. In embodiments, the domains of the CAR are on the same polypeptide chain, for example a chimeric fusion protein. In embodiments, the domains are on different polypeptide chains, for example the domains are not contiguous.

The extracellular domain of a CAR molecule includes an antigen binding domain. In embodiments, the antigen binding domain binds an antigen, for example, a cell surface molecule or marker, on the surface of a B cell. In embodiments, the cell surface molecule of a B cell includes CD19, CD22, CD20, BCMA, CD5, CD7, CD2, CD16, CD56, CD30, CD14, CD68, CD11b, CD18, CD169, CD1c, CD33, CD38, CD138, or CD13. In embodiments, the cell surface molecule of the B cell is CD19, CD20, CD22, or BCMA. In particular embodiments, the cell surface molecule of the B cell is CD19.

In embodiments, the antigen binding domain binds an antigen, on the surface of a tumor for example a tumor antigen or tumor marker. Tumor antigens are proteins that are produced by tumor cells that elicit an immune response, particularly T cell mediated immune responses. Tumor antigens are well known in the art and include, for example, tumor associated MUC1 (tMUC1), a glioma-associated antigen, carcinoembryonic antigen (CEA), β-human chorionic gonadotropin, alphafetoprotein (AFP), lectin-reactive AFP, thyroglobulin, RAGE-1, MN-CA IX, human telomerase reverse transcriptase, RU1, RU2 (AS), intestinal carboxyl esterase, mut hsp70-2, M-CSF, prostase, prostate-specific antigen (PSA), PAP, NY-ESO-1, LAGE-1a, p53, prostein, PSMA, Her2/neu, surviving, telomerase, prostate-carcinoma tumor antigen-1 (PCTA-1), MAGE, ELF2M, neutrophil elastase, ephrinB2, CD22, insulin growth factor (IGF)-I, IGF-II, IGF-I receptor and mesothelin. For example, when the tumor antigen is CD19, and the CAR thereof can be referred to as CD19CAR.

In embodiments, the extracellular antigen binding domain of a CAR includes at least one scFv or at least a single domain antibody. As an example, there can be two scFvs on a CAR. The scFv includes a light chain variable (VL) region and a heavy chain variable (VH) region of a target antigen-specific monoclonal antibody joined by a flexible linker. Single chain variable region fragments can be made by linking light and/or heavy chain variable regions by using a short linking peptide (Bird et al., Science 242:423-426, 1988). An example of a linking peptide is the GS linker having the amino acid sequence $(GGGGS)_3$ SEQ ID NO: 124, which bridges approximately 3.5 nm between the carboxy terminus of one variable region and the amino terminus of the other variable region. Linkers of other sequences have been designed and used (Bird et al., 1988, supra). In general, linkers can be short, flexible polypeptides and preferably comprised of about 20 or fewer amino acid residues. The single chain variants can be produced either recombinantly or synthetically. For synthetic production of scFv, an automated synthesizer can be used. For recombinant production of scFv, a suitable plasmid containing polynucleotide that encodes the scFv can be introduced into a suitable host cell, either eukaryotic, such as yeast, plant, insect or mammalian cells, or prokaryotic, such as E. coli. Polynucleotides encoding the scFv of interest can be made by routine manipulations such as ligation of polynucleotides. The resultant scFv can be isolated using standard protein purification techniques known in the art.

In embodiments, the CAR molecules described herein comprises one or more CDRs for binding an antigen of interest, for example, one or more CDRs of CD19 or tMUC1.

The cytoplasmic domain of the CAR molecules described herein includes one or more co-stimulatory domains and one or more signaling domains. The co-stimulatory and signaling domains function to transmit the signal and activate molecules, such as T cells, in response to antigen binding. The one or more co-stimulatory domains are derived from stimulatory molecules and/or co-stimulatory molecules, and the signaling domain is derived from a primary signaling domain, such as the CD3 zeta domain. In embodiments, the signaling domain further includes one or more functional signaling domains derived from a co-stimulatory molecule. In embodiments, the co-stimulatory molecules are cell surface molecules (other than antigens receptors or their ligands) that are required for activating a cellular response to an antigen.

In embodiments, the co-stimulatory domain includes the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds CD83, or any combination thereof. In embodiments, the signaling domain includes a CD3 zeta domain derived from a T cell receptor.

In embodiments, the cytoplasmic domain of the CAR only includes one or more stimulatory domains and no signaling domain.

The CAR molecules also include a transmembrane domain. The incorporation of a transmembrane domain in the CAR molecules stabilizes the molecule. In embodiments, the transmembrane domain of the CAR molecules is the transmembrane domain of a CD28 or 4-1BB molecule.

Between the extracellular domain and the transmembrane domain of the CAR, there may be incorporated a spacer domain. As used herein, the term "spacer domain" generally means any oligo- or polypeptide that functions to link the transmembrane domain to, either the extracellular domain or, the cytoplasmic domain on the polypeptide chain. A spacer domain may include up to 300 amino acids, preferably 10 to 100 amino acids, and most preferably 25 to 50 amino acids.

CAR Molecule(s) and Therapeutic Agent(s)

The present disclosure describes isolated nucleic acids including a (first) nucleic acid encoding a CAR and an additional (second) nucleic acid encoding one or more therapeutic agents. In embodiments, the first nucleic acid and the second nucleic acid are on separate isolated nucleic acids. In embodiments, the first and second nucleic acid are on the same isolated nucleic acid. In embodiments, the one or more therapeutic agents is IFN-γ, IL-2, IL-6, IL-7, IL-15, IL-17, IL-23, or a combination thereof. In embodiments, the therapeutic agent is Eomes, TRAF6, IL12, IL2, IL18, IL23, AQP9, Runx3, AMPK, BCL-2, or a combination thereof.

The present disclosure also describes isolated nucleic acids including a first nucleic acid encoding a first CAR and a second nucleic acid encoding the one or more therapeutic agents. Moreover, the present disclosure describes isolated nucleic acids including a third nucleic acid encoding a second (or additional) CAR. In embodiments, a separate isolated nucleic acid includes a nucleic acid encoding the second CAR. In embodiments, the first nucleic acid and the second nucleic acid are on separate isolated nucleic acids.

In embodiments, that first CAR includes an antigen binding domain that binds a solid tumor, and the second (or additional) CAR includes an antigen binding domain that binds a white blood cell (WBC).

The present disclosure also describes vectors including the isolated nucleic acids described above. In embodiments, a single vector contains the isolated nucleic acid encoding the first CAR, the therapeutic agent, and the second CAR or TCR. In embodiments, a first vector contains the first nucleic acid encoding a first CAR and a nucleic acid encoding one or more therapeutic agents, and a second vector contains the nucleic acid encoding the second CAR or TCR. In embodiments, the vector comprises an isolated nucleic acid encoding a bispecific CAR including at least two antigen binding domains and one or more therapeutic agents.

In embodiments, the present disclosure describes an isolated nucleic acid sequence comprising a nucleic acid sequence and an additional nucleic acid sequence, the nucleic acid sequence encoding a chimeric antigen receptor (CAR), the additional nucleic acid sequence encoding a therapeutic agent that is or comprises at least one of IL-2, IL-6, IL-7, IL-15, IL-17, and IL-23. In embodiments, the therapeutic agent is or comprises Eomes, TRAF6, IL12, IL2, IL18, IL23, AQP9, Runx3, AMPK, or BCL-2.

In embodiments, the present disclosure describes a pharmaceutical composition for treating a subject having a tumor using modified T cells, wherein the pharmaceutical composition comprises modified T cells comprising a first nucleic acid sequence encoding a chimeric antigen receptor (CAR) and a second nucleic acid encoding a therapeutic agent comprising IL-6, IFN-γ, or a combination thereof. In embodiments, the tumor is a solid tumor. In embodiments, the tumor is a liquid tumor (e.g., NHL). Embodiments relate to a method of causing or inducing T cell response in a subject in need thereof, the method comprising administering an effective amount of the pharmaceutical composition to the subject. The method described herein is effective in treating a subject diagnosed with cancer. In embodiments, the subject is diagnosed with a solid tumor.

Embodiments relate to certain cytokines, for example IL-6 and IFNγ, are selected to be expressed or overexpressed in T cells, which are used to treat tumors (e.g., solid and/or liquid tumors). These cytokines at least do not directly or indirectly weaken the killing function, capability of inhibiting tumor cells, and/or has severe side effects on T cell therapy. For example, these selected cytokines are capable of enhancing T cell response. Interestingly, IL-6 was considered as a cytokine that reduces or at least has a negative impact on T cell therapy since it is the major contributor to Cytokine Release Syndrome (CRS). However, the Examples provided herein show that the increase of IL-6 is consistent with the efficacy in treating Relapsed/Refractory (R/R) Acute Lymphoid Leukemia (ALL) using CAR T cell therapy. Surprisingly, the Examples provided herein show infusion of CAR T cells expressing and secreting IL-6 do not cause severe CRS for treating solid tumors. Not all cytokine can be expressed and secreted by T cells without sacrificing their function to kill tumor cells and/or inhibit tumor growth. The tumor-promoting effects of certain cytokines have been reported. For example, IL-10 production by TAMs can blunt anti-tumor responses by inhibiting the functions of APCs and subsequently block T cell effector functions such as cytotoxicity (Mannino, M. H., Zhu, Z., Xiao, H., Bai, Q., Wakefield, M. R., and Fang, Y. (2015). Studies in mouse tumor models have shown that IL-10 can suppress tumor-infiltrating DC maturation and their production of IL-12 to stimulate Th1 cells, unless IL-10 signaling is simultaneously blocked (Vicari, A. P., Chiodoni, C., Vaure, C., Ait-Yahia, S., Dercamp, C., Matsos, F., Reynard, O., Taverne, C., Merle, P., Colombo, M. P., et al. (2002). Reversal of tumor-induced dendritic cell paralysis by CpG immunostimulatory oligonucleotide and anti-interleukin 10 receptor antibody. J. Exp. Med. 196, 541-549.). As another example, studies have shown that TGF-β can be a potent inhibitor of T cell proliferation (Kehrl J H, Wakefield L M, Roberts A B, Jakowlew S, Alvarez-Mon M, et al. 1986. Production of transforming growth factor β (TGF-β) by human T lymphocytes and its potential role in the regulation of T cell growth. J. Exp. Med. 163:1037-50). Several mechanisms drive TGF-β-mediated inhibition of T cell proliferation, including suppression of IL-2 production, downregulation of c-myc, and upregulation of cyclin-dependent kinase inhibitors (Li M O, Wan Y Y, Sanjabi S, Robertson A K, Flavell R A. 2006. Transforming growth factor-β regulation of immune responses. Annu. Rev. Immunol. 24:99-146). In some contexts, TGF-β also plays an important role in promoting cell death to limit T cell expansion after activation (Mark A. Travis and Dean Sheppard, TGF-β Activation and Function in Immunity, Annu. Rev. Immunol. 2014. 32:51-82).

Chemokines are a large family of cytokines that direct normal leukocyte migration. They also have been implicated in leukocyte development and in the pathogenesis of many diseases. Also, some chemokines' concentration gradients play an important role in intranodal T-cell migration. Overexpression of these chemokines would disrupt T cells migration, thus weakening CAR T cell therapy for solid tumor. Without proper migration, T cells may not be able to reach tumor cells. For example, it has been reported that overexpression of the chemokine CCL21 disrupts T cell migration (Christopherson K W and Campbell J J, Hromas R A, Transgenic overexpression of the CC chemokine CCL21 disrupts T-cell migration, Blood. 2001 Dec. 15; 98(13): 3562-8). In embodiments, cytokines over-expressed or expressed in the modified cells does not include at least one of IL-10, TGF-β and CCL21. Certain cytokines can be overexpressed or expressed in T cells to enhance CAR T therapy treating tumors. However, some cytokines (e.g., IL-6) cannot be overexpressed or expressed in T cells to treat blood tumor. It is well-known that IL-6 is the major factor that contributes to severe CRS in CAR T treatment of blood tumors such as ALL and NHL. However, IL-6 can be overexpressed or expressed in T cells for the treatment of solid tumors because there are few studies reporting severe CRS in CAR T cell treatment of solid tumor. In embodiments, expression and secretion of IL-6 by T cells may be associated with a condition of T cells to avoid CRS and other syndromes related to IL-6. For example, IL-6 may be expressed and secreted by T cells when the T cells are activated. In embodiments, expression and secretion of IL-6 by CAR T cells may be regulated by a transcription modulator such as NFAT such that the CAR T cells may neither express nor secrete IL-6 unless they recognize and bind their antigen.

In embodiments, the modified T cells express and secrete the therapeutic agent. In embodiments, the therapeutic agent comprises IL-6 and IFN-γ. In embodiments, the modified T cell comprises nucleic acid sequences encoding SEQ ID NOS: 287 and 328. In embodiments, the modified T cell comprises the nucleic acid sequences comprises SEQ ID NOS: 286 and 469, and a nucleic acid sequence encodes SEQ ID NO: 328.

In embodiments, the CAR comprises an extracellular domain, a transmembrane domain, and an intracellular domain, the extracellular domain binds an antigen. In embodiments, the CAR binds tMUC 1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Rα2, Mesothelin, PSMA, ROR1, VEGFR-II, GD2, FR-α, ErbB2, EpCAM, EGFRvIII, PSCA, or EGFR. In embodiments, the intracellular domain comprises a co-stimulatory domain that comprises an intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof. In embodiments, the antigen is Epidermal growth factor receptor (EGFR), Variant III of the epidermal growth factor receptor (EGFRvIII), Human epidermal growth factor receptor 2 (HER2), Mesothelin (MSLN), Prostate-specific membrane antigen (PSMA), Carcinoembryonic antigen (CEA), Disialoganglioside 2 (GD2), Interleukin-13Ra2 (IL13Rα2), Glypican-3 (GPC3), Carbonic anhydrase IX (CAIX), L1 cell adhesion molecule (L1-CAM), Cancer antigen 125 (CA125), Cluster of differentiation 133 (CD133), Fibroblast activation protein (FAP), Cancer/testis antigen 1B (CTAG1B), Mucin 1 (MUC1), Folate receptor-α (FR-α), CD19, FZD10, TSHR, PRLR, Muc 17, GUCY2C, CD207, CD3, CD5, B-Cell Maturation Antigen (BCMA), or CD4.

In embodiments, the therapeutic agent is present in the modified T cell in a recombinant DNA construct, in an mRNA, or in a viral vector. In embodiments, the modified T cell comprises a nucleic acid sequence comprising a promoter comprising a binding site for a transcription modulator that modulates the expression and/or secretion of the therapeutic agent in the modified cell. In embodiments, the transcription modulator is or comprises Hif1a, NFAT, FOXP3, or NFkB. In embodiments, the promoter is responsive to the transcription modulator. In embodiments, the promoter is operably linked to the nucleic acid sequence encoding the therapeutic agent such that the promoter drives expression and/or secretion of the therapeutic agent. In embodiments, the promoter comprises at least one of SEQ ID Nos: 323-325.

In embodiments, the CAR and the therapeutic agent are produced in the form of a polyprotein, which is cleaved to generate separate CAR and therapeutic agent molecules, and there is a cleavable moiety between the CAR and the therapeutic agent, the cleavable moiety comprises a 2A peptide, the 2A peptide comprises P2A or T2A.

In embodiments, the modified T cell comprises an additional (second) CAR, the CAR binds a solid tumor antigen, and the additional CAR binds an antigen of a white blood cell. In some embodiments, the solid tumor antigen is tMUC 1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Rα2, Mesothelin, PSMA, ROR1, VEGFR-II, GD2, FR-α, ErbB2, EpCAM, EGFRvIII, PSCA, or EGFR, and the antigen of the white blood cell is CD19, CD20, CD22, or BCMA. In embodiments, the modified cell comprises a dominant negative PD-1.

Embodiments relate to an isolated nucleic acid comprising a nucleic acid sequence and an additional nucleic acid sequence, the nucleic acid encoding a chimeric antigen receptor (CAR), the additional nucleic acid encoding a therapeutic agent that comprises at least one of TNFRSF superfamily member receptor activation antibodies or membrane-bound forms thereof, TNFRSF superfamily member ligands or the membrane-bound form thereof, chemokines or membrane-bound forms thereof, antibodies to the chemokines, or antibodies to receptors of the chemokines or the membrane-bound forms thereof, and D28 family's ligands that correspond to the sequences in Table 2-4. For example, TNFRSF superfamily member receptor includes tumor necrosis factor receptor 1, Tumor necrosis factor receptor 2, Lymphotoxin beta receptor, Lymphotoxin beta receptor, CD40, Fas receptor, Decoy receptor 3, CD27, CD30, 4-1BB, Death receptor 4, Death receptor 5, Decoy receptor 1, Decoy receptor 2, RANK, Osteoprotegerin, TWEAK receptor, TACI, BAFF receptor, Herpesvirus entry mediator, Nerve growth factor receptor, B-cell maturation antigen, Glucocorticoid-induced TNFR-related, TROY, Death receptor 6, Death receptor 3, Ectodysplasin A2 receptor, and the like.

In embodiments, the therapeutic agent includes an antibody reagent (e.g., a single chain antibody (e.g., scFv), a single domain antibody (e.g., a camelid antibody), or a bispecific antibody reagent (e.g., a bispecific T cell engager (BiTE)). In embodiments, the therapeutic agent includes a cytokine. Examples of the cytokines include IL-1P, IL-2, IL-4, IL-5, IL-6, IL-8, IL-10, IL-12, IL-13, IL-15, IL-17, IL-1Ra, IL-2R, IFN-γ, IFN-γ, MIP-In, MIP-IP, MCP-1, TNFα, GM-CSF, GCSF, CXCL9, CXCL10, CXCR factors, VEGF, RANTES, EOTAXIN, EGF, HGF, FGF-P, CD40, CD40L, ferritin, and any combination thereof. In embodiments, the cytokines include proinflammatory cytokines such as: IFN-γ, IL-15, IL-4, IL-10, TNFα, IL-8, IL-5, IL-6, GM-CSF, and MIP-Iα. For example, IFN-γ has been approved by FDA to treat patients with malignant osteoporosis (e.g., Journal of Pediatrics 121(1):119-24•August 1992).

T present disclosure describes a population of CAR cells comprising the nucleic acid and the additional nucleic acid, wherein the CAR cells comprise lymphocyte, leukocyte, or PBMC. In embodiments, the CAR and the therapeutic agent are produced in the form of a polyprotein, which is cleaved to generate separate CAR and therapeutic agent molecules. In embodiments, the polyprotein comprises a cleavable moiety between the CAR and the therapeutic agent, the cleavable moiety comprising a 2A peptide, the 2A peptide comprises P2A or T2A. In embodiments, the CAR and the therapeutic agent are each constitutively expressed. In embodiments, the CAR cells comprise: a third nucleic acid sequence encoding an additional CAR binding to an antigen that is different from the CAR, or the additional CAR binding a solid tumor antigen, and the CAR binds an antigen of a white blood cell. In embodiments, the therapeutic agent or its variants can be produced either recombinantly or synthetically. For synthetic production of the therapeutic agent, an automated synthesizer can be used. For recombinant production of the therapeutic agent, a suitable plasmid containing polynucleotide that encodes the therapeutic agent can be introduced into a suitable host cell, either eukaryotic, such as yeast, plant, insect or mammalian cells, or prokaryotic, such as *E. coli*. Polynucleotides encoding the therapeutic agent of interest can be made by routine manipulations such as ligation of polynucleotides. The resultant therapeutic agent can be isolated using standard protein purification techniques known in the art.

The present disclosure describes a pharmaceutical composition comprising the population of the CAR cells. Embodiments relate to a method of inducing or enhancing T cell response in a subject in need thereof and/or treating a tumor of the subject, the method comprising administering an effective amount of the composition to the subject.

The present disclosure describes a modified cell comprising one or more CARs, wherein the cell is engineered to express and secrete one or more therapeutic agents comprising at least one of IL-2, IL-6, IL-7, IL-15, IL-17, and IL-23. In embodiments, the cell is engineered to express the therapeutic agent, which is bound to the membrane of the modified cell.

The present disclosure describes a method of causing or enhancing T cell response, treating cancer, or enhancing cancer treatment, the method comprising: administrating an effective amount of the composition of T cells comprising one or more CARs, wherein the cell is engineered to express and secrete a therapeutic agent that is or comprises at least one of IL-2, IL-6, IL-7, IL-15, IL-17, and IL-23, and the T cell response is enhanced as compared to the administration of T cells that do not express or secrete the therapeutic agent.

The present disclosure describes a method of causing or enhancing T cell response, treating cancer, or enhancing cancer treatment, the method comprising: administering an effective amount of the composition of a population of T cells comprising a CAR; and administering an effective amount of a therapeutic agent comprising at least one of IL-2, IL-6, IL-7, IL-15, IL-17, and IL-23, wherein the T cell response is enhanced as compared to the administration of CAR T cells without the administration of therapeutic agent. In embodiments, the administering the effective amount of the therapeutic agent comprises intravenous delivery of an amount of human IL-6 in the range of about 0.5-50 ug per kilogram of body weight. In embodiments, the therapeutic agent is IL-6 or IL-7.

In embodiments, the method further comprises monitoring a concentration of the therapeutic agent in tissue or blood of the subject; and administering an antagonist of receptors of the therapeutic agent or the therapeutic agent (e.g., antibodies) if the concentration and/or other parameters of the subject are not in a desired condition. For example, the parameters may include a level of body temperatures, a level CRS, and a level of neuronal toxicity etc.

In embodiments, the expression and/or secretion of the therapeutic agent may be is regulated by an inducible expression system. In embodiments, the inducible expression system is a rtTA-TRE system, which increases or activates the expression of therapeutic agent, or a combination thereof. In embodiments, the inducible expression system is the rtTA-TRE system. For example, Tetracycline-Controlled Transcriptional Activation is a method of inducible gene expression where transcription is reversibly turned on or off in the presence of the antibiotic tetracycline or one of its derivatives (e.g., doxycycline). In embodiments, the expression and/or secretion of the therapeutic agent may be regulated by an inducible expression system and/or the modified cell comprises a nucleic acid sequence encoding an inducible suicide system. For example, the inducible suicide system is an HSV-TK system or an inducible caspase-9 system.

In embodiments, the T cell comprises an additional (second) CAR binding an antigen of a WBC, and the first CAR binds an antigen of a solid tumor. In embodiments, the solid tumor antigen is tMUC 1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Rα2, Mesothelin, PSMA, ROR1, VEGFR-II, GD2, FR-α, ErbB2, EpCAM, EGFRvIII, PSCA, or EGFR, and the B cell antigen is CD19, CD20, CD22, or BCMA.

In embodiments, the CAR comprises an extracellular domain, a transmembrane domain, and an intracellular domain, the extracellular domain binds an antigen.

In embodiments, the intracellular domain comprises a co-stimulatory domain that comprises an intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof.

In embodiments, the antigen is Epidermal growth factor receptor (EGFR), Variant III of the epidermal growth factor receptor (EGFRvIII), Human epidermal growth factor receptor 2 (HER2), Mesothelin (MSLN), Prostate-specific membrane antigen (PSMA), Carcinoembryonic antigen (CEA), Disialoganglioside 2 (GD2), Interleukin-13Ra2 (IL13Rα2), Glypican-3 (GPC3), Carbonic anhydrase IX (CAIX), L1 cell adhesion molecule (L1-CAM), Cancer antigen 125 (CA125), Cluster of differentiation 133 (CD133), Fibroblast activation protein (FAP), Cancer/testis antigen 1B (CTAG1B), Mucin 1 (MUC1), Folate receptor-α (FR-α), CD19, FZD10, TSHR, PRLR, Muc 17, GUCY2C, CD207, CD3, CD5, B-Cell Maturation Antigen (BCMA), or CD4.

In embodiments, the modified cell or T cells comprise a dominant negative PD-1 mutant such that PD-1/PDI-1 signaling pathway of the cell is interfered.

In embodiments, the therapeutic agent is present in the modified cell in a recombinant DNA construct, in an mRNA, or in a viral vector. In embodiments, the modified cell comprises a therapeutic agent mRNA encoding the therapeutic agent, and the mRNA is not integrated into the genome of the modified cell. In embodiments, the therapeutic agent mRNA may be introduced (e.g., electroporated) into the modified cell such that the expression and/or secretion of the therapeutic agent is transient. Synthetic mRNAs can be injected to achieve transient gene expression. For example, the therapeutic agent supplied by the mRNA is short-lived such that the release of the therapeutic agent is controllable, especially for proinflammatory cytokines such as: IFN-γ, IL-4, IL-10, TNFα, IL-8, IL-5, IL-6, GM-CSF, and MIP-Iα.

In embodiments, the therapeutic agent comprises or is at least one listed in Table 2. In embodiments, the therapeutic agent comprises or has the sequence listed in Table 2.

In embodiments, the modified cell includes a nucleic acid sequence comprising the isolated nucleic acids described herein, wherein the isolated nucleic acid includes a promoter comprising a binding site for a transcription modulator (e.g., transcription factors) that modulates the expression of the therapeutic agent in the cell. Examples of the isolated nucleic acid sequence are provided in Table 2-4. These constructs may be placed into vectors (e.g., lentiviral vectors) either in a forward or reverse direction. In embodiments, the transcription modulator includes Hif1a, NFAT, FOXP3, and/or NFkB. In embodiments, the promoter is responsive to the transcription modulator. In embodiments, the promoter is operably linked to the nucleic acid sequence encoding the therapeutic agent, such that the promoter drives expression of the therapeutic agent in the cell. In embodiments, the therapeutic agent is ligated to a specific promoter such as to induce expression of the therapeutic agent in a desired condition. The promoter is divided into two parts, a specific regulatory region containing a transcription factor binding site, plus a minimal promoter. In embodiments, the promoter and the binding site includes the sequences listed in Table 2-4. More information about NFAT may be found at WO2018006882, which is incorporated herein by reference.

Embodiments relate to an isolated nucleic acid sequence comprising a (first) nucleic acid and an additional (second) nucleic acid sequence, the first nucleic acid encoding a chimeric antigen receptor (CAR), the second nucleic acid encoding a therapeutic agent. For example, the therapeutic agent comprises IL-6 or IFN-γ, or a combination thereof. For example, the therapeutic agent comprises IL-15 or IL-12, or a combination thereof. Embodiments relate to a population of CAR cells comprising the isolated nucleic acid, wherein the CAR cells comprise lymphocyte, leukocyte, or PBMC. In embodiments, the population of CAR cells comprise the CAR and the therapeutic agent produced in the form of a polyprotein, which is cleaved to generate separate CAR and therapeutic agent molecules. In embodiments, the polyprotein comprises a cleavable moiety between the CAR and the therapeutic agent, the cleavable moiety comprises a 2A peptide, the 2A peptide comprising P2A or T2A. In embodiments, the CAR and the therapeutic agent are each constitutively expressed. In embodiments, the CAR cells comprise: a third nucleic acid sequence encoding a second CAR binding to an antigen that is different from the first CAR. In embodiments, the second CAR binds a solid tumor antigen, and the first CAR binds an antigen of a white blood cell.

Embodiments relate to a pharmaceutical composition comprising the population of the cells including one or more CAR molecules (the CAR cells) and one or more therapeutic agents. Embodiments also relate to a method of inducing or causing T cell response in a subject in need thereof, the method comprising administering an effective amount of the pharmaceutical composition described herein to the subject. In embodiments, the CAR cell or the modified cell is a T cell, a NK cell, a macrophage or a dendritic cell. In embodiments, the CAR cell or the modified cell is a T cell.

In embodiments, the additional (second) nucleic acid comprises two nucleic acids, one encoding IL6 and one encoding IFN-γ, and the two nucleic acids are connected by an IRES element or another nucleic acid encoding a 2A peptide. In embodiments, the additional (second) nucleic acid comprises the nucleic acid sequence of SEQ ID NOs: 287 or 328, or a combination thereof. In embodiments, expression of the additional (second) nucleic acid is regulated by a conditional expression system such that the therapeutic agent is expressed in response to binding of a target antigen. In embodiments, expression of the additional nucleic acid sequence is regulated by SynNotch polypeptide.

Embodiments relate to a FC fusion protein associated with a small protein (e.g., a cytokine) as described above. In embodiments, the therapeutic agent may comprise the FC fusion protein. For example, cytokines such as IL15, IFN-γ or IL6 may be linked to one or more immunoglobin Fc domains. In embodiments, the Fc domain folds independently and may improve the solubility and stability of the small protein both in vitro and in vivo. In embodiments, the Fc region allows for easy cost-effective purification by protein-G/A affinity chromatography during manufacture. In embodiments, the FC fusion protein may be modified to polymerize into well-defined complexes containing multiple small proteins. In embodiments, the fusion protein may be expressed and secreted by the modified cell (e.g., a CAR T cell), which is used to treat a subject with cancer and/or other diseases. In embodiments, administration of the fusion protein may be combined with treatment of CAR T cells expressing and secreting the fusion protein. For example, a method for enhancing T cell response and/or treating a subject with cancer or other diseases may comprise administrating a fusion protein associated with the small protein (e.g., IFN-γ) to a subject and administrating an effective amount of the composition of a population of T cells comprising a CAR and expressing as well as secreting the fusion protein associated with the small protein to the subject. In embodiments, the administration of the fusion protein may enhance expansion of the CAR T cells during the early stage of the CAR T treatment (e.g., 1, 2, 3, 4, 5, or 6 days after the infusion of the CAR T cells). For example, the fusion protein may be administrated into the subject 1, 2, 3, 4, 5, or 6 days after the infusion of the CAR T cells. In embodiments, the method may comprise administrating a fusion protein associated with the small protein (e.g., IFN-γ) to a subject and administrating an effective amount of the composition of a population of T cells comprising a CAR without expressing or secreting the fusion protein associated with the small protein to the subject. For example, the fusion protein may be administrated into the subject for a predetermined time. More information about the FC fusion protein may be found at *J Immunol* 2004; 172:2925-2934 and EM BO Mol Med. 2012 October; 4(10): 1015-1028, which are incorporated by reference. More information about administration of the therapeutic agent (e.g. cytokines) may be fund at J Interferon Cytokine Res. 2019 January; 39(1): 6-21, which is incorporated by reference.

Embodiments relate to a modified cell comprising one or more CARs, wherein the cell is engineered to express and secrete one or more therapeutic agents. For example, the therapeutic agent comprises IL-6 or IFN-γ, or a combination thereof. Embodiments relate to a method of inducing or enhancing T cell response, treating cancer, or enhancing cancer treatment, the method comprising: administrating an effective amount of the pharmaceutical composition of T cells comprising one or more CARs, wherein the cell is engineered to express and secrete one or more therapeutic agents. For example, the therapeutic agent comprises IL-6 or IFN-γ, or a combination thereof. In embodiments, the therapeutic agent is a small protein associated with IL-6 or IFN-γ. For example, administration of IL-15 to a subject may increase concentrations of IL-6 and IFN-γ up to 50-fold in the blood of the patient. Embodiments relate to a method of causing or enhancing T cell response, treating cancer, or enhancing cancer treatment, the method comprising: administering an effective amount of the composition of a population of T cells comprising a CAR; and administering an effective amount of a therapeutic agent. For example, therapeutic agent comprises IL-6 or IFN-γ, or a combination thereof. In embodiments, the CAR cells, the modified cell, the cell is a T cell, a NK cell, a macrophage or a dendritic cell. For example, the CAR cells, the modified cell, the cell is a T cell. Embodiments relate to a method for enhancing T cell response and/or treating a subject with cancer or other diseases may comprise administrating a therapeutic agent (e.g., a recombinant or native IFN-γ) to a subject and administrating an effective amount of a composition comprising a population of T cells comprising a CAR and expressing as well as secreting one or more therapeutic agents in the subject. In embodiments, the therapeutic agent may enhance expansion of the CAR T cells during the early stage of the CAR T treatment (e.g., 1, 2, 3, 4, 5, or 6 days after the infusion of the CAR T cells). For example, the therapeutic agent may be administrated into the subject 1, 2, 3, 4, 5, or 6 days after the infusion of the CAR T cells. In embodiments, the method may comprise administrating a therapeutic agent to a subject and administrating an effective amount of the composition of a population of T cells comprising a CAR without expressing or secreting the therapeutic to the subject. For example, the therapeutic agent may be administrated into the subject for a predetermined time. In embodiments, the therapeutic agent may be modified such that the biological and/or pharmacological properties of the therapeutic agent may be enhanced. For example, the hybrid FC fusion technology may be implemented to the solubility and/or stability of an active ingredient of the therapeutic agent.

In embodiments, the therapeutic agent may be isolated, synthetic, native, or recombinant human cytokines. For example, Recombinant human IL-15 may be administered as a daily bolus infusion for predetermined time days at 3 mcg/kg/day and 1 mcg/kg/day. Recombinant human IFN-γ may be administered at a dose of 2 million units daily for 5 days per week over predetermined time. In embodiments, the administering the effective amount of the therapeutic agent comprises administering an effective amount of the therapeutic agent such that concentrations of IL-6 and/or IFN-γ in the blood of the subject may increase 5-1000 times (e.g., 50 times). For example, the therapeutic agent comprises IL-15.

In embodiments, T cell response is enhanced as compared to the administration of T cells that do not express or secrete the therapeutic agent, or the T cell response is enhanced as compared to the administration of CAR T cells without the administration of therapeutic agent.

In embodiments, expression and/or secretion of the therapeutic agent is regulated by an inducible expression system and/or the modified cell comprises a nucleic acid sequence encoding an inducible suicide system. In embodiments, the inducible expression system is the rtTA-TRE system. In embodiments, the inducible suicide system is an HSV-TK system or an inducible caspase-9 system.

In embodiments, the modified T cells express and/or secrete the one or more therapeutic agents in response to the activation of the modified T cells. Such conditional expression and/or secretion may be implemented in various manners. The expression and/or secretion of the one or more therapeutic agents in the modified cell may be modulated by a transcription modulator (e.g., N FAT). TRUCKs (T cells redirected for universal cytokine killing), CAR-redirected T cells, may be used to express and/or secrete the one or more therapeutic agents when these T cells are activated. The expression and/or secretion of the one or more therapeutic agents in the modified cell may also be regulated by a SynNotch polypeptide.

In embodiments, a range of concentration values of IL6 is 60 to 5000 pg/ml, 200-5000 pg/ml, or 2000-5000 pg/ml in the blood of the subject. In embodiments, a range of concentration values IFN-γ is 20 to 5000 pg/ml, 200 to 5000 pg/ml, or 500 to 5000 pg/ml in the blood of the subject. In embodiments, the administering an effective amount of the therapeutic agent comprises intravenous delivery of an amount of human IL-6 in the range of about 0.5-50 ug per kilogram of body weight. In embodiments, the modified cell expresses the therapeutic agent such that concentrations of IL-6 and/or IFN-γ in the blood of the subject may increase 5-1000 times (e.g., 50 times). For example, the therapeutic agent comprises IL-15. More detailed information about IFN-γ clinical uses may be found at Cancer Med. 2018, 7: 4509-4516, which is incorporated by reference.

In embodiments, the modified cells or the T cells comprise an additional (second) CAR binding an antigen of a WBC, and the CAR binds an antigen of a solid tumor. In embodiments, the solid tumor antigen is tMUC 1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Rα2, Mesothelin, PSMA, ROR1, VEGFR-II, GD2, FR-α, ErbB2, EpCAM, EGFRvIII, PSCA, or EGFR, and the B cell antigen is CD19, CD20, CD22, or BCMA.

In embodiments, the modified cells or the T cells comprise a dominant negative PD-1. In embodiments, the modified cell or the T cells comprise a modified PD-1 lacking a functional PD-1 intracellular domain.

In embodiments, the CAR comprises an extracellular domain, a transmembrane domain, and an intracellular domain, the extracellular domain binds an antigen. In embodiments, the intracellular domain comprises a co-stimulatory domain that comprises an intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and one combination thereof. In embodiments, the antigen is Epidermal growth factor receptor (EGFR), Variant III of the epidermal growth factor receptor (EGFRvIII), Human epidermal growth factor receptor 2 (HER2), Mesothelin (MSLN), Prostate-specific membrane antigen (PSMA), Carcinoembryonic antigen (CEA), Disialoganglioside 2 (GD2), Interleukin-13Ra2 (IL13Rα2), Glypican-3 (GPC3), Carbonic anhydrase IX (CAIX), L1 cell adhesion molecule (L1-CAM), Cancer antigen 125 (CA125), Cluster of differentiation 133 (CD133), Fibroblast activation protein (FAP), Cancer/testis antigen 1B (CTAG1B), Mucin 1 (MUC1), Folate receptor-α (FR-α), CD19, FZD10, TSHR, PRLR, Muc 17, GUCY2C, CD207, CD3, CD5, B-Cell Maturation Antigen (BCMA), or CD4.

In embodiments, the therapeutic agent is present in the modified cell in a recombinant DNA construct, in an mRNA, or in a viral vector. In embodiments, the modified cell comprises a therapeutic agent mRNA encoding the therapeutic agent, and the mRNA is not integrated into the genome of the modified cell. In embodiments, the modified cell comprises a nucleic acid sequence comprising a promoter which comprises a binding site for a transcription modulator that modulates the expression and/or secretion of the therapeutic agent in the cell. In embodiments, the transcription modulator includes Hif1a, NFAT, FOXP3, and/or NFkB. In embodiments, the promoter is responsive to the transcription modulator. In embodiments, the promoter is operably linked to the nucleic acid sequence encoding the therapeutic agent such that the promoter drives expression and/or secretion of the therapeutic agent in the cell. In embodiments, the promoter comprises at least one of SEQ ID Nos: 323-325.

In embodiments, the CAR cells, the modified cell, the cell is a T cell, a NK cell, a macrophage or a dendritic cell. For example, the CAR cells, the modified cell, the cell is a T cell.

In embodiments, the population of cells described herein is used in autologous CAR T cell therapy. In embodiments, the CAR T cell therapy is allogenic CAR T cell therapy, TCR T cell therapy, and NK cell therapy.

CAR Molecules

In addition to the embodiments described above, the present disclosure describes isolated nucleic acids encoding at least two different antigen binding domains. In embodiments, there is a first antigen binding domain that binds an antigen on the surface of a WBC, and there is a second antigen binding domain that binds an antigen on a tumor that is different from the antigen on the surface of a WBC. The first antigen binding domain functions to expand the cells that it is introduced into, while the second antigen binding domain functions to inhibit the growth of or kill tumor cells containing the target tumor antigen upon binding to the target antigen. In embodiments, an isolated nucleic acid described herein encodes both the first and second antigen binding domains on the same nucleic acid molecule. In embodiments, the two antigen binding domains are encoded by two separate nucleic acid molecules. For example, a first nucleic acid encodes a first antigen binding domain and a second nucleic acid encodes a second antigen binding domain.

In embodiments, the present disclosure describes nucleic acids encoding a first antigen binding domain of a binding molecule and a second antigen binding domain of a binding molecule, wherein first antigen binding domain binds a cell surface molecule of a WBC, and the second antigen binding domain binds an antigen different from the cell surface molecule of the WBC. In embodiments, the second binding domain does not bind a B cell marker. In embodiments, the second binding domain includes a scFv comprising an amino acid sequence of SEQ ID No: 264 or 265. For example, the second antigen binding domain is on a CAR having one of the amino acid sequences of SEQ ID Nos: 271-277.

In embodiments, the first and second antigen binding domains can be on two different binding molecules (first and second binding molecules) such as a first CAR and a second CAR. As an example, a first CAR includes an extracellular binding domain that binds a marker on the surface of a B cell, and a second CAR includes an extracellular binding domain that binds a target antigen of a tumor cell. In embodiments, the first CAR and second CAR are encoded by different nucleic acids. In embodiments, the first CAR and second CAR are two different binding molecules but are encoded by a single nucleic acid.

In embodiments, the two different antigen binding domains can be on the same binding molecule, for example on a bispecific CAR, and encoded by a single nucleic acid. In embodiments, the bispecific CAR can have two different scFv molecules joined together by linkers.

In embodiments, the two different antigen binding domains can be on a CAR and a T cell receptor (TCR) and are encoded by separate nucleic acids. The binding domain of a TCR can target a specific tumor antigen or tumor marker on the cell of a tumor. In embodiments the TCR binding domain is a TCR alpha binding domain or TCR beta binding domain that targets a specific tumor antigen. In embodiments, the TCR comprises the TCRγ and TORδ chains or the TCRα and TCRβ chains. The present disclosure also describes vectors including the isolated nucleic acids described above. In embodiments, a single vector contains the isolated nucleic acid encoding the first CAR and second CAR or TCR. In embodiments, a first vector contains the first nucleic acid encoding a first CAR, a second vector contains the nucleic acid encoding the second CAR or TCR. In embodiments, the vector comprises a bispecific CAR including at least two antigen binding domains.

Moreover, the present disclosure describes cells comprising the isolated nucleic acids or vectors described above. The cells have been introduced with the isolated nucleic acids or vectors described herein and express at least two more binding domains. In embodiments, the cells include two or more different binding domains, a first antigen binding domain and a second antigen binding domain, wherein the first antigen binding domain binds a cell surface molecule of a WBC, and the second antigen binding domain binds an antigen different from the cell surface molecule of a WBC. Further, the present disclosure describes compositions including a population of the cells described herein. In embodiments, the cells are peripheral blood mononuclear cells (PBMCs) such as lymphocytes. In embodiments, the lymphocytes are T cells, NK cell, or dendritic cells.

The present disclosure also describes methods of culturing cells described above. The methods described herein includes obtaining a cell comprising a first antigen binding domain and a second antigen binding domain, wherein the first antigen binding domain binds a cell surface molecule of a WBC, and the second antigen binding domain binds an antigen different from the cell surface molecule of the WBC; and culturing the cell in the presence of an agent derived from a cell surface molecule of the WBC or from an antigen to which the second antigen binding domain binds. In embodiments, the agent is an extracellular domain of a cell surface molecule of a WBC.

The present disclose describes methods for in vitro cell preparation, wherein the method includes providing cells; introducing one or more nucleic acids encoding a first antigen binding domain and a second antigen binding domain into the cells, wherein the first antigen binding domain binds a cell surface molecule of a WBC, and the second antigen binding domain binds an antigen different from the cell surface molecule of the WBC; and culturing the cells in the presence of an agent derived from the cell surface molecule of the WBC or from an antigen to which the second antigen binding domain binds.

The present disclosure describes using the prepared cells preparation to enhance T cell expansion in a subject having cancer. In embodiments, the method comprises introducing a plurality of nucleic acids into T cells, the plurality of nucleic acids encoding a chimeric antigen receptor (CAR) binding a solid tumor antigen and encoding a CAR binding a B cell antigen, at least a portion of the T cells comprising the CAR binding the solid tumor antigen and the CAR binding the B cell antigen; and administering an effective amount of the T cells to the subject. The T cell expansion is enhanced or the number of T cells is increased in the subject as compared to a subject that is administered with T cells comprising the plurality of nucleic acids encoding only one CAR.

Additionally, the present disclosure describes methods for introducing and/or enhancing lymphocyte (T cell) response in a subject. Embodiments described herein involve a mechanism that expands lymphocytes and a mechanism that relates to binding of an antigen on a CAR to a tumor cell. In embodiments, the first mechanism involves a molecule associated with a signal that is involved in expanding the lymphocytes in a subject, and an additional mechanism involves a molecule associated with a signal directed to binding, inhibiting the growth of, or killing a tumor cell in the subject. For example, the first mechanism includes a CAR binding to an antigen associated with blood, such as blood cells and blood plasma, or non-essential tissues, and the additional mechanism includes a CAR or TCR targeting an antigen associated with the tumor cell. Examples of non-essential tissues include the mammary gland, colon, gastric gland, ovary, blood components, such WBC, and thyroid. In embodiments, the first mechanism involves a first binding domain of a molecule, and the additional mechanism involves a second domain of a molecule. In embodiments, the first mechanism and the additional mechanism are performed by the same molecule or by separate molecules. In particular embodiments, the mechanism involves a cell expressing an antigen associated with a tumor cell, and the additional mechanism involves a lymphocyte having an antigen binding domain.

The methods described herein involves lymphocytes including an expansion molecule and a function molecule. In embodiments, the expansion molecule expands the lymphocytes in a subject, and/or the function molecule inhibits the growth of or kills a tumor cell in the subject. In embodiments, the expansion molecule and the function molecule are on a single CAR molecule, for example a bispecific CAR molecule. In embodiments, the expansion molecule and the function molecule are on separate molecules, for example, CAR and TCR or two different CARs. The expansion molecule can include a CAR binding to an antigen associated with blood (e.g., blood cells and blood plasma) or non-essential tissues, and the function molecule can include a CAR or TCR targeting an antigen associated with the tumor cell.

Lymphocyte or T cell response in a subject refers to cell-mediated immunity associated with a helper, killer, regulatory, and other types of T cells. For example, T cell response may include activities such as assisting other WBCs in immunologic processes and identifying and destroying virus-infected cells and tumor cells. T cell response in the subject can be measured via various indicators such as a number of virus-infected cells and/or tumor cells that T cells kill, the amount of cytokine that T cells release in co-culturing with virus-infected cells and/or tumor cells, a level of proliferation of T cells in the subject, a phenotype change of T cells, for example, changes to memory T cells, and a level longevity or lifetime of T cells in the subject.

In embodiments, the method of enhancing T cell response comprises treating a subject in need thereof, for example, a subject diagnosed with a tumor. The term tumor refers to a mass, which can be a collection of fluid, such as blood, or a solid mass. A tumor can be malignant (cancerous) or benign. Examples of blood cancers include chronic lymphocytic leukemia, acute myeloid leukemia, acute lymphoblastic leukemia, and multiple myeloma.

Solid tumors usually do not contain cysts or liquid areas. The major types of malignant solid tumors include sarcomas and carcinomas. Sarcomas are tumors that develop in soft tissue cells called mesenchymal cells, which can be found in blood vessels, bone, fat tissues, ligament lymph vessels, nerves, cartilage, muscle, ligaments, or tendon, while carcinomas are tumors that form in epithelial cells, which are found in the skin and mucous membranes. The most common types of sarcomas include undifferentiated pleomorphic sarcoma which involves soft tissue and bone cells; leiomyosarcoma which involves smooth muscle cells that line blood vessels, gastrointestinal tract, and uterus; osteosarcoma which involves bone cells, and liposarcoma which involves fat cells. Some examples of sarcomas include Ewing sarcoma, Rhabdomyosarcoma, chondosarcoma, mesothelioma, fibrosarcoma, fibrosarcoma, and glioma.

The five most common carcinomas include adrenocarcinoma which involves organs that produce fluids or mucous, such as the breasts and prostate; basal cell carcinoma which involves cells of the outer-most layer of the skin, for example, skin cancer; squamous cell carcinoma which involves the basal cells of the skin; and transitional cell carcinoma which affects transitional cells in the urinary tract which includes the bladder, kidneys, and ureter. Examples of carcinomas include cancers of the thyroid, breast, prostate, lung, intestine, skin, pancreas, liver, kidneys, and bladder, and cholangiocarcinoma.

The methods described herein can be used to treat a subject diagnosed with cancer. The cancer can be a blood cancer or can be a solid tumor, such as a sarcoma or carcinoma. The method of treating includes administering an effective amount of T cells comprising a first antigen binding domain and a second antigen binding domain to the subject to provide a T-cell response, wherein the first antigen binding domain binds a cell surface molecule of a WBC, and the second antigen binding domain binds an antigen different from the cell surface molecule of the WBC. In embodiments, enhancing the T cell response in the subject includes selectively enhancing proliferation of T cell expressing the first antigen binding domain and the second antigen binding domain in vivo.

In embodiments, the T cells for enhancing T cell response in a subject includes administering to the subject, T cells comprising a bispecific CAR including two different binding domains or administering T cells comprising a first CAR and a second CAR, wherein the first CAR and the second CAR, each includes a different antigen binding domain.

In embodiments, methods for enhancing T cell response in a subject includes administering a T cell including a CAR molecule and a TCR molecule. The CAR molecule targets or binds a surface marker of a white blood cell, and the TCR molecule binds a marker or an antigen of the tumor that is expressed on the surface or inside the tumor cell.

The present disclosure describes methods of expanding cells expressing an antigen binding domain in vivo. The method includes administering an effective amount of T cells comprising a first antigen binding domain and a second antigen binding domain to a subject in need thereof, wherein the first antigen binding domain binds a cell surface molecule of a WBC, and the second antigen binding domain binds an antigen different from the cell surface molecule of the WBC. The methods are useful for expanding or increasing the number of T cells, NK cells, dendritic cells.

In embodiments, the first antigen binding domain is on a first chimeric antigen receptor (CAR) and the second antigen binding domain is on a second CAR or a TCR. For example, the first CAR and the second CAR or TCR include an extracellular antigen binding domain, a transmembrane domain, and a cytoplasmic domain. The cytoplasmic domain of the first CAR include a co-stimulatory domain and a CD3 zeta domain for transmitting signals for activation of cellular responses. In embodiments, the cytoplasmic domain of the first CAR includes one or more co-stimulatory domains in the absence of a CD3 zeta domain such that activation or stimulation of the first CAR expands WBCs, such as lymphocytes, without introducing and/or activating the killing function of the WBCs. In embodiments, the lymphocytes are T cells.

In embodiments, the first and second antigen binding domains are on the same CAR (the first CAR), for example, a bispecific CAR with an extracellular antigen binding domain, a transmembrane domain, and a cytoplasmic domain. The extracellular antigen binding domain includes at least two scFvs and at least one of the scFvs function as a first antigen binding domain for binding a cell surface molecule of a WBC.

In embodiments, the antigen different from the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, CD13, B7, CAIX, CD123, CD133, CD171, CD171/L1-CAM, CEA, Claudin 18.2, cMet, CS1, CSPG4, Dectin1, EGFR, EGFR vIII, EphA2, ERBB receptors, ErbB T4, ERBB2, FAP, Folate receptor 1, FITC, Folate receptor 1, FSH, GD2, GPC3, HA-1 H/HLA-A2, HER2, IL-11Ra, IL13 receptor a2, IL13R, IL13Rα2 (zetakine), Kappa, Leukemia, LewisY, Mesothelin, MUC1, NKG2D, NY-ESO-1, PSMA, ROR-1, TRAIL-receptor1, or VEGFR2.

In embodiments, the MUC1 is a tumor-exclusive epitope of a human MUC1, and the first CAR and the second CAR or the TCR are expressed as separate polypeptides. In embodiments, the MUC1 is a tumor form of human MUC1 (tMUC1).

In embodiments, the first CAR includes a co-stimulatory domain without a signaling domain, such as the CD3 zeta domain, and the MUC1 CAR (second CAR) comprises the MUC1 binding domain, a transmembrane domain, a co-stimulatory, and a CD3 zeta domain.

As used herein, the term "MUC1" refers to a molecule defined as follows. MUC1 is one of the epithelial mucin family of molecules. MUC1 is a transmembrane mucin glycoprotein that is normally expressed on all glandular epithelial cells of the major organs. In normal cells, MUC1 is only expressed on the apical surface and is heavily glycosylated with its core proteins sequestered by the carbohydrates. As cells transform to a malignant phenotype, expression of MUC1 increases several folds, and the expression is no longer restricted to the apical surface, but it is found all around the cell surface and in the cytoplasm. In addition, the glycosylation of tumor associated MUC1 is aberrant, with greater exposure of the peptide core than is found on MUC1 expressed in normal tissues. Little is known regarding the specifics of the aberrant glycosylation.

MUC1 is widely expressed on a large number of epithelial cancers and is aberrantly glycosylated making it structurally and antigenically distinct from that expressed by non-malignant cells (see, e.g., Barratt-Boyes, 1996; Price et al., 1998; Peterson et al., 1991). The dominant form of MUC1 is a high molecular weight molecule comprising a large highly immunogenic extracellular mucin-like domain with a large number of twenty amino acid tandem repeats, a transmembrane region, and a cytoplasmic tail (Quin et al., 2000; McGucken et al., 1995; Dong et al., 1997).

In most epithelial adenocarcinomas including breast and pancreas, MUC1 is overexpressed and aberrantly glycosylated. Adenocarcinoma of the breast and pancreas not only overexpress MUC1 but also shed MUC1 into the circulation. High MUC1 serum levels are associated with progressive disease. MUC1 has been exploited as a prospective biomarker because of the complex and heterogeneous nature of the epitopes expressed within the antigen. MUC1 synthesized by cancerous tissues (e.g., tumor associated MUC1) usually displays an aberrant oligosaccharide profile, which gives rise to the expression of neomarkers such as sialyl-Lea (assayed in the CA19-9 test), sialyl-Lex, and sialyl-Tn (TAG-72), as well as the cryptic epitopes such as Tn.

Several antibodies are being developed against MUC1 for therapeutic use. Pemtumomab (also known as HMFG1) is in Phase III clinical trials as a carrier to deliver the radioisotope Yttrium-90 into tumors in ovarian cancer (reviewed in Scott et al., 2012). CA15-3 (also the HMFG1 antibody), CA27-29, and CA19-9 are all antibodies to MUC1 that are used to assess levels of circulating MUC1 in patients with cancer. However, these antibodies have shown limited utility as therapeutic agents or as biomarkers because they cannot distinguish effectively between MUC1 expressed on normal versus transformed tumor epithelia. In other words, none of these antibodies appear to be targeted to a tumor-specific MUC1 epitope.

A new antibody that is highly specific for a tumor-specific form of MUC1 (tMUC) is designated TAB-004 and is described in U.S. Pat. No. 8,518,405 (see also Curry et al., 2013). While Pemtumomab (HMFG1) was developed using human milk fat globules as the antigen (Parham et al., 1988), TAB-004 was developed using tumors expressing an altered form of MUC1 (Tinder et al., 2008). TAB-004 recognizes the altered glycosylated epitope within the MUC1 tandem repeat sequence. This area is accessible for antigenic detection in tMUC but is blocked from antigenic detection in normal MUC1 by large branches of glycosylation (Gendler, 2001; Mukherjee et al., 2003b; Hollingsworth & Swanson, 2004; Kufe, 2009). Importantly, TAB-004 is different from the epitopes recognized by other MUC1 antibody and has unique complementary determinant regions (CDRs) of the heavy and light chains. The antibody binds the target antigen with a high binding affinity at 3 ng/ml (20 pM) and does not bind unrelated antigens (Curry et al., 2013). Thus, TAB-004 distinguishes between normal and tumor form of MUC1 while HMFG1 (Pemtumomab) does not (see U.S. Pat. No. 8,518,405).

In embodiments, the WBC is a granulocyte, monocyte and or lymphocyte. In embodiments, the WBC is a B cell.

In embodiments, the first CAR comprises the first antigen binding domain, a transmembrane domain, a co-stimulatory domain, and a CD3 zeta domain and/or the second CAR comprises the second antigen binding domain, a transmembrane domain, a co-stimulatory domain, and a CD3 zeta domain.

In embodiments, the antigen binding domain is a Fab or a scFv. In embodiments, the first CAR comprises the amino acid sequence of one of SEQ ID NO: 5, 6, and 53-58; and the second CAR comprises the amino acid sequence of one of SEQ ID NOs: 5-17, 29, 33, 37, 71, and 72, or the amino acid sequence encoded by the nucleic acid sequence of one of SEQ ID Nos: 41, 45, 63, 67, and 68. In embodiments, a nucleic acid sequence encoding the first CAR comprises the nucleic acid sequence of SEQ ID NO: 59 or 60, and a nucleic acid sequence encoding the second CAR comprises the nucleic acid sequence of SEQ ID NO: 61. In embodiments, the isolated nucleic acid comprises one of the nucleic acid sequence of SEQ ID NO: 62-69. In embodiments, the first CAR and the second CAR are expressed as separate polypeptides.

In embodiments, the first antigen binding domain is on a CAR and the second antigen binding domain is on a T Cell Receptor (TCR). In embodiments, the TCR is a modified TCR. In embodiments, the TCR is derived from spontaneously occurring tumor-specific T cells in patients. In embodiments, the TCR binds a tumor antigen. In embodiments, the tumor antigen comprises CEA, gp100, MART-1, p53, MAGE-A3, or NY-ESO-1.

In embodiments, a T cell clone that expresses a TCR with high affinity for the target antigen may be isolated. Tumor-infiltrating lymphocytes (TILs) or peripheral blood mononuclear cells (PBMCs) can be cultured in the presence of antigen-presenting cells (APCs) pulsed with a peptide representing an epitope known to elicit a dominant T cell response when presented in the context of a defined HLA allele. High-affinity clones may be then selected on the basis of MHC-peptide tetramer staining and/or the ability to recognize and lyse target cells pulsed with low titrated concentrations of cognate peptide antigen. After the clone has been selected, the TCRα and TCRβ chains or TCRγ and TORO chains are identified and isolated by molecular cloning. For example, for TCRα and TCRβ chains, the TCRα and TCRβ gene sequences are then used to generate an expression construct that ideally promotes stable, high-level expression of both TCR chains in human T cells. The transduction vehicle, for example, a gammaretrovirus or lentivirus, can then be generated and tested for functionality (antigen specificity and functional avidity) and used to produce a clinical lot of the vector. An aliquot of the final product can then be used to transduce the target T cell population (generally purified from patient PBMCs), which is expanded before infusion into the patient.

Various methods may be implemented to obtain genes encoding tumor-reactive TCR. More information is provided in Kershaw et al., Clin Transl Immunology. 2014 May; 3(5): e16. In embodiments, specific TCR can be derived from spontaneously occurring tumor-specific T cells in patients. Antigens included in this category include the melanocyte differentiation antigens MART-1 and gp100, as well as the MAGE antigens and NY-ESO-1, with expression in a broader range of cancers. TCRs specific for viral-associated malignancies can also be isolated, as long as viral proteins are expressed by transformed cells. Malignancies in this category include liver and cervical cancer, associated with hepatitis and papilloma viruses, and Epstein-Barr virus-associated malignancies. In embodiments, target antigens of the TCR may include CEA (e.g., for colorectal cancer), gp100, MART-1, p53 (e.g., for Melanoma), MAGE-A3 (e.g., Melanoma, esophageal and synovial sarcoma), NY-ESO-1 (e.g., for Melanoma and sarcoma as well as Multiple myelomas).

In embodiments, a binding domain of the first CAR binds CD19, and a binding domain of the second CAR binds tumor associated MUC1. In embodiments, the binding domain of the second CAR comprises: (i) a heavy chain complementary determining region 1 comprising the amino acid sequence of SEQ ID: 76 or 85, a heavy chain complementary determining region 2 comprising the amino acid sequence of SEQ ID: 77 or 86, and a heavy chain complementary determining region 3 comprising the amino acid sequence of SEQ ID: 78 or 87; and (ii) a light chain complementary determining region 1 comprising the amino acid sequence of SEQ ID: 73 or 82, a light chain complementary determining region 2 comprising the amino acid sequence of TRP-ALA-SER (WAS) or SEQ ID: 83, and a light chain complementary determining region 3 comprising the amino acid sequence of SEQ ID: 75 or 84.

In embodiments, the binding domain of the second CAR comprises: (i) a heavy chain complementary determining region 1 comprising the amino acid sequence of SEQ ID: 76, a heavy chain complementary determining region 2 comprising the amino acid sequence of SEQ ID: 77, and a heavy chain complementary determining region 3 comprising the amino acid sequence of SEQ ID: 78; and (ii) a light chain complementary determining region 1 comprising the amino acid sequence of SEQ ID: 73, a light chain complementary determining region 2 comprising the amino acid sequence of TRP-ALA-SER (WAS), and a light chain complementary determining region 3 comprising the amino acid sequence of SEQ ID: 75.

In embodiments, the binding domain of the second CAR comprises: (i) a heavy chain complementary determining region 1 comprising the amino acid sequence of SEQ ID: 85, a heavy chain complementary determining region 2 comprising the amino acid sequence of SEQ ID: 86, and a heavy chain complementary determining region 3 comprising the amino acid sequence of SEQ ID: 87; and (ii) a light chain complementary determining region 1 comprising the amino acid sequence of SEQ ID: 82, a light chain complementary determining region 2 comprising the amino acid sequence of SEQ ID: 83, and a light chain complementary determining region 3 comprising the amino acid sequence of SEQ ID: 84. In embodiments, the binding domain of the first CAR comprises the amino acid sequence of SEQ ID: 5 or 6. In embodiments, the binding domain of the second CAR comprises one of the amino acid sequences of SEQ ID: 70-72 and 79-81.

In embodiments, the first CAR comprises the first antigen binding domain, a transmembrane domain, a co-stimulatory domain, and a CD3 zeta domain and/or the second CAR comprises the second antigen binding domain, a transmembrane domain, a co-stimulatory domain, and a CD3 zeta domain.

In embodiments, the first CAR and the second CAR are expressed as separate polypeptides.

In embodiments, the cytoplasmic domain or the transmembrane domain of the second CAR is modified such that the second CAR is capable of activating the modified T cell via cells expressing CD19 without damaging the cells expressing CD19.

Embodiments described herein relate to a bispecific chimeric antigen receptor, comprising: a first antigen binding domain, a second antigen binding domain, a cytoplasmic domain, and transmembrane domain, wherein the first antigen binding domain recognizes a first antigen, and the second antigen binding domain recognizes a second antigen, the first antigen is different from the second antigen.

In embodiments, the first antigen and the second antigen do not express on the same cell. In embodiments, the first antigen is an antigen of a blood component, and the second antigen is an antigen of a solid tumor.

Blood cells refer to red blood cells (RBCs), white blood cells (WBCs), platelets, or other blood cells. For example, RBCs are blood cells of delivering oxygen ($O_2$) to the body tissues via the blood flow through the circulatory system. Platelets are cells that are involved in hemostasis, leading to the formation of blood clots. WBCs are cells of the immune system involved in defending the body against both infectious disease and foreign materials. There are a number of different types and sub-types of WBCs and each has a different role to play. For example, granulocytes, monocytes, and lymphocytes are 3 major types of white blood cell. There are three different forms of granulocytes: Neutrophils, Eosinophils, Basophils.

A cell surface molecule of a WBC refers to a molecule expressed on the surface of the WBC. For example, the cell surface molecule of a lymphocyte may include CD19, CD22, CD20, BCMA, CD5, CD7, CD2, CD16, CD56, and CD30. The cell surface molecule of a B cell may include CD19, CD20, CD22, BCMA. The cell surface molecule of a monocyte may include CD14, CD68, CD11b, CD18, CD169, and CD1c. The cell surface molecule of granulocyte may include CD33, CD38, CD138, and CD13.

In embodiments, the first antigen is CD19, and the second antigen is a tumor associated MUC1. In embodiments, the first antigen binding domain comprises one of the amino acid sequences of SEQ ID: 5 and 6. In embodiments, the second antigen binding domain comprises one of the amino acid sequence of SEQ ID: 70-72 and 79-81.

In embodiments, the present disclosure describes a method of enhancing T cell response in a subject or treating a tumor of the subject, the method comprising: administering an effective amount of modified T cell to the subject to provide a T cell response such that the CART cell is expanded in the blood of the subject via cells expressing CD19.

In embodiments, the tumor associated MUC1 is expressed on tumor cells, but not on corresponding non-malignant cells. In embodiments, a scFv against the tumor associated MUC1 directly interacts with an o-glycosylated GSTA motif (SEQ ID NO. 88).

Embodiments described herein relate to a cell comprising the bispecific CAR and to an isolated nucleic acid encoding the bispecific CAR.

In embodiments, the present disclosure describes a method of in vivo cell expansion. In embodiments, the method may include administering an effective amount of T cell comprising a CAR to the subject to provide a T cell response; and administering an effective amount of presenting cells (e.g., T cells) expressing a soluble agent that an extracellular domain of the CAR recognizes. In embodiments, the method may be implemented to enhance T cell response in a subject. The method may include administering an effective amount of T cell comprising a CAR to the subject to provide a T cell response and administering an effective amount of presenting cells expressing a soluble agent that an extracellular domain of the CAR recognizes to enhance the T cell response in the subject. In certain embodiments, the presenting cells are T cells, dendritic cells, and/or antigen presenting cells. In certain embodiments, the enhancing T cell response in the subject may include selectively enhancing proliferation of T cell comprising the CAR. In embodiments, the method may be used to enhance treatment of a condition on a subject using CAR T cells. The method may include administering a population of cells that express an agent or administering an agent that is formulated as a vaccine. In these instances, the CAR T cells include a nucleic acid that encodes a CAR, and an extracellular domain of the CAR recognize the agent. In embodiments, the method may be implemented to enhance proliferation of CAR T cells in a subject having a disease. The method may include preparing CAR T cells comprising a CAR; administering an effective amount of the CAR T cells to the subject; introducing, into cells, a nucleic acid encoding an agent that an extracellular domain of the CAR recognizes; and administering an effective amount of the cells (introduced with the nucleic acid encoding the agent) to the subject. In embodiments, the T cell expansion or increased in the number of T cells may be measured based on an increase in copy number of CAR molecules in genomic DNA of the T cells. In embodiments, the T cell expansion or increased in the number of T cells may be measured based on flow cytometry analysis on molecules expressed on the T cells.

Embodiments described herein relate to an isolated T cell comprising a first CAR, and a second CAR, wherein an antigen binding domain of the first CAR binds an antigen such as CD19, CD33, CD14, and BCMA, and an antigen binding domain of the second CAR binds a tumor associated MUC. In embodiments, the tumor associated MUC is MUC1 or MUC2. Embodiments described herein relate to a composition comprising a population of the isolated T cells and to a method of enhancing T cell response in a subject or treating a tumor of the subject, the method comprising: administering an effective amount of the isolated T cell.

In embodiments, the first CAR comprises the amino acid sequence of SEQ ID NO: 207, and the second CAR comprises the amino acid sequence of SEQ ID: 202. In embodiments, the first CAR comprises the amino acid sequence of SEQ ID NO: 203, 207, 216, or 219, and the second CAR comprises the amino acid sequence of SEQ ID: 202 or 205. In embodiments, the antigen binding domain of the second CAR comprises the amino acid sequence of SEQ ID NO: 70. In embodiments, the antigen binding domain of the second CAR comprises the amino acid sequence of SEQ ID NO: 5 or 6. In embodiments, the isolated T cell comprises a nucleic acid sequence of SEQ ID NO: 201, 204, 206, 208, 215, 217, 218, or 220. In embodiments, each of the first CAR and the second CAR comprises an antigen binding domain, a transmembrane domain, and a cytoplasmic domain.

In embodiments, the cytoplasmic domain comprises a co-stimulatory domain and a CD3 zeta domain.

In embodiments, the isolated T cell comprises a dominant negative variant of a receptor of programmed death 1 (PD-1), cytotoxic T lymphocyte antigen-4 (CTLA-4), B- and T-lymphocyte attenuator (BTLA), T cell immunoglobulin mucin-3 (TIM-3), lymphocyte-activation protein 3 (LAG-3), T cell immunoreceptor with Ig and ITIM domains (TIGIT), leukocyte-associated immunoglobulin-like receptor 1 (LAIRI), natural killer cell receptor 2B4 (2B4), or CD 160. In embodiments, the isolated T cell comprises a reduced amount of TCR, as compared to the corresponding wide-type T cell. Dominant negative mutations have an altered gene product that acts antagonistically to the wild-type allele. These mutations usually result in an altered molecular function (often inactive) and are characterized by a dominant or semi-dominant phenotype.

The present disclosure describes pharmaceutical compositions. The pharmaceutical compositions include one or more of the following: CAR molecules, TCR molecules, modified CAR T cells, modified cells comprising CAR or TCR, modified cells, nucleic acids, and vectors described above. Pharmaceutical compositions are administered in a manner appropriate to the disease to be treated (or prevented). The quantity and frequency of administration will be determined by such factors as the condition of the patient, and the type and severity of the patient's disease, although appropriate dosages may be determined by clinical trials.

When "an immunologically effective amount", "an anti-tumor effective amount", "a tumor-inhibiting effective amount", or "therapeutic amount" is indicated, the precise amount of the compositions of the present disclosure to be administered can be determined by a physician with consideration of individual differences in age, weight, tumor size, extent of infection or metastasis, and condition of the patient (subject). It can be stated that a pharmaceutical composition comprising the T cells described herein may be administered at a dosage of $10^4$ to $10^9$ cells/kg body weight, preferably $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., New Eng. J. of Med. 319:1676, 1988). The optimal dosage and treatment regime for a particular patient can readily be determined by one skilled in the art of medicine by monitoring the patient for signs of disease and adjusting the treatment accordingly. In certain embodiments, it may be desired to administer activated T cells to a subject and then subsequently redraw the blood (or have apheresis performed), collect the activated and expanded T cells, and reinfuse the patient with these activated and expanded T cells. This process can be carried out multiple times every few weeks. In certain embodiments, T cells can be activated from blood draws of from 10 cc to 400 cc. In certain embodiments, T cells are activated from blood draws of 20 cc, 30 cc, 40 cc, 50 cc, 60 cc, 70 cc, 80 cc, 90 cc, or 100 cc. Not to be bound by theory, using this multiple blood draw/multiple reinfusion protocols, may select out certain populations of T cells.

The administration of the pharmaceutical compositions described herein may be carried out in any convenient manner, including by aerosol inhalation, injection, ingestion, transfusion, implantation, or transplantation. The compositions described herein may be administered to a patient subcutaneously, intradermally, intratumorally, intranodally, intramedullary, intramuscularly, by intravenous (i. v.) injection, or intraperitoneally. In embodiments, the T cell compositions described herein are administered to subjects by intradermal or subcutaneous injection. In embodiments, the T cell compositions of the present disclosure are administered by i.v. injection. The compositions of T cells may be injected directly into a tumor, lymph node, or site of infection. In embodiments, cells activated and expanded using the methods described herein, or other methods known in the art where T cells are expanded to therapeutic levels, are administered to patients in conjunction with (e.g., before, simultaneously or following) any number of relevant treatment modalities, including but not limited to treatment with agents for antiviral therapy, cidofovir and interleukin-2, Cytarabine (also known as ARA-C); or natalizumab treatment for MS patients; or efalizumab treatment for psoriasis patients or other treatments for PML patients. In further embodiments, the T cells described herein can be used in combination with chemotherapy, radiation, immunosuppressive agents, such as cyclosporin, azathioprine, methotrexate, mycophenolate, and FK506, antibodies, or other immunoablative agents such as CAM PATH, anti-CD3 antibodies or other antibody therapies, cytoxin, fludaribine, cyclosporin, FK506, rapamycin, mycophenolic acid, steroids, FR901228, cytokines, and irradiation. These drugs inhibit either the calcium dependent phosphatase calcineurin (cyclosporine and FK506) or inhibit the p70S6 kinase that is important for growth factor induced signaling (rapamycin). (Liu et al., Cell 66:807-815, 1991; Henderson et al., Immun 73:316-321, 1991; Bierer et al., Curr. Opin. Immun 5:763-773, 1993; Isoniemi (supra)). In embodiments, the cell compositions described herein are administered to a subject in conjunction with (e.g., before, simultaneously or following) bone marrow transplantation, T cell ablative therapy using either chemotherapy agents such as, fludarabine, external-beam radiation therapy (XRT), cyclophosphamide, or antibodies such as OKT3 or CAMPATH. In embodiments, the cell compositions described herein are administered following B-cell ablative therapy. For example, agents that react with CD20, e.g., Rituxan may be administered to patients. In embodiments, subjects may undergo standard treatment with high dose chemotherapy followed by peripheral blood stem cell transplantation. In certain embodiments, following the transplant, subjects receive an infusion of the expanded immune cells of the present disclosure. In embodiments, expanded cells are administered before or following surgery.

The dosage of the above treatments to be administered to a subject in need thereof will vary with the precise nature of the condition being treated and the recipient of the treatment. The scaling of dosages for human administration can be performed according to art-accepted practices by a physician depending on various factors.

Additional information on the methods of cancer treatment using engineered or modified T cells is provided in U.S. Pat. No. 8,906,682, incorporated by reference in its entirety.

Embodiments described herein relate to an in vitro method for preparing modified cells. The method may include obtaining a sample of cells from a subject. For example, the sample may include T cells or T cell progenitors. The method may further include transfecting the sample of cells with a DNA encoding at least a CAR and culturing the population of CAR cells ex vivo in a medium that selectively enhances proliferation of CAR-expressing T cells.

In embodiments, the sample is a cryopreserved sample. In embodiments, the sample of cells is from umbilical cord blood or a peripheral blood sample from the subject. In embodiments, the sample of cells is obtained by apheresis or venipuncture. In embodiments, the sample of cells is a subpopulation of T cells.

Tables 2-4

TABLE 2

| Name | SEQ ID NO: | Name | SEQ ID NO: | Name | SEQ ID NO: |
|---|---|---|---|---|---|
| SP | 1 | UPK2 | 101 | Construct of MUC1-5E5-A-IRES-CD19-A | 201 |
| Hinge & transmembrane domain | 2 | ADAM12 | 102 | CAR 1 of MUC1-5E5-A-IRES-CD19-A | 202 |
| Co-stimulatory domain | 3 | SLC45A3 | 103 | CAR 2 of MUC1-5E5-A-IRES-CD19-A | 203 |
| CD3-zeta | 4 | ACPP | 104 | Construct of MUC1-5E5-B-IRES-CD19-A | 204 |
| scFV Humanized CD19 | 5 | MUC21 | 105 | CAR 1 of MUC1-5E5-B-IRES-CD19-A | 205 |
| scFV CD19 | 6 | MUC16 | 106 | CAR 2 of MUC1-5E5-B-IRES-CD19-A | 203 |
| scFv FZD10 | 7 | MS4A12 | 107 | Construct of MUC1-5E5-A-IRES-CD19-B | 206 |
| scFv TSHR | 8 | ALPP | 108 | CAR 1 of MUC1-5E5-A-IRES-CD19-B | 202 |
| scFv PRLR | 9 | SLC2A14 | 109 | CAR 2 of MUC1-5E5-A-IRES-CD19-B | 207 |
| scFv Muc 17 | 10 | GS1-259H13.2 | 110 | Construct of MUC1-5E5-B-IRES-CD19-B | 208 |
| scFv GUCY2C | 11 | ERVFRD-1 | 111 | CAR 1 of MUC1-5E5-B-IRES-CD19-B | 205 |
| scFv CD207 | 12 | ADGRG2 | 112 | CAR 2 of MUC1-5E5-B-IRES-CD19-B | 207 |
| Prolactin (ligand) | 13 | ECEL1 | 113 | Construct of MUC1-2-A-IRES-CD19-A | 209 |
| scFv CD3 | 14 | CHRNA2 | 114 | CAR 1 of MUC1-2-A-IRES-CD19-A | 210 |
| scFv CD4 | 15 | GP2 | 115 | CAR 2 of MUC1-2-A-IRES-CD19-A | 203 |
| scFv CD4-2 | 16 | PSG9 | 116 | Construct of MUC1-2-B-IRES-CD19-A | 211 |
| scFv CD5 | 17 | SIGLEC15 | 117 | CAR 1 of MUC1-2-B-IRES-CD19-A | 212 |
| CD19 antigen | 18 | SLC6A3 | 118 | CAR 2 of MUC1-2-B-IRES-CD19-A | 203 |
| FZD10 antigen | 19 | KISS1R | 119 | Construct of MUC1-2-A-IRES-CD19-B | 213 |
| TSHR antigen | 20 | QRFPR | 120 | CAR 1 of MUC1-2-A-IRES-CD19-B | 210 |
| PRLR antigen | 21 | GPR119 | 121 | CAR 2 of MUC1-2-A-IRES-CD19-B | 207 |
| Muc 17 antigen | 22 | CLDN6 | 122 | Construct of MUC1-2-B-IRES-CD19-B | 214 |
| GUCY2C antigen | 23 | SP-2 | 123 | CAR 1 of MUC1-2-B-IRES-CD19-B | 212 |
| CD207 antigen | 24 | Linker-2 | 124 | CAR 2 of MUC1-2-B-IRES-CD19-B | 207 |
| CD3 antigen | 25 | Hinge-2 | 125 | Construct of MUC1-5E5-A-IRES-hCD19-A | 215 |
| CD4 antigen | 26 | TM-2 | 126 | CAR 1 of MUC1-5E5-A-IRES-hCD19-A | 202 |
| CD5 antigen | 27 | 4-1BB-2 | 127 | CAR 2 of MUC1-5E5-A-IRES-hCD19-A | 216 |
| CAR CD19 nucleic acid | 28 | CD3 zeta-2 | 128 | Construct of MUC1-5E5-B-IRES-hCD19-A | 217 |
| Hinge & TM domain B | 29 | CLDN6-CAR-1 | 129 | CAR 1 of MUC1-5E5-B-IRES-hCD19-A | 205 |
| Hinge & TM domain A | 30 | ScFv CLDN6-CAR-1 | 130 | CAR 2 of MUC1-5E5-B-IRES-hCD19-A | 216 |
| Hinge & TM domain D | 31 | ScFv VL CLDN6-CAR-1 | 131 | Construct of MUC1-5E5-A-IRES-hCD19-B | 218 |
| Hinge & TM domain C | 32 | ScFv VH CLDN6-CAR-1 | 132 | CAR 1 of MUC1-5E5-A-IRES-hCD19-B | 202 |
| Hinge domain D | 33 | CLDN6-CAR-2 | 133 | CAR 2 of MUC1-5E5-A-IRES-hCD19-B | 219 |
| Hinge domain C | 34 | ScFv CLDN6-CAR-2 | 134 | Construct of MUC1-5E5-B-IRES-hCD19-B | 220 |
| Hinge domain B | 35 | ScFv VL CLDN6-CAR-2 | 135 | CAR 1 of MUC1-5E5-B-IRES-hCD19-B | 205 |
| Hinge domain A | 36 | ScFv VH CLDN6-CAR-2 | 136 | CAR 2 of MUC1-5E5-B-IRES-hCD19-B | 219 |

TABLE 2-continued

| Name | SEQ ID NO: | Name | SEQ ID NO: | Name | SEQ ID NO: |
|---|---|---|---|---|---|
| TM domain D | 37 | CLDN6-CAR-3 | 137 | Construct of MUC1-2-A-IRES-hCD19-A | 221 |
| TM domain A | 38 | scFv CLDN6-CAR-3 | 138 | CAR 1 of MUC1-2-A-IRES-hCD19-A | 210 |
| CD19 extracellular domain | 39 | scFv VL CLDN6-CAR-3 | 139 | CAR 2 of MUC1-2-A-IRES-hCD19-A | 216 |
| TM domain C or B | 40 | scFv VH CLDN6-CAR-3 | 140 | Construct of MUC1-2-B-IRES-hCD19-A | 222 |
| WTCD3zeta | 41 | CLDN6-CAR-4 | 141 | CAR 2CAR 1 of MUC1-2-B-IRES-hCD19-A | 212 |
| WTCD3zeta-BCMACAR full length | 42 | scFv CLDN6-CAR-4 | 142 | Construct of MUC1-2-B-IRES-hCD19-A | 216 |
| BCMA | 43 | scFv VL CLDN6-CAR-4 | 143 | Construct of MUC1-2-A-IRES-hCD19-B | 223 |
| BCMA CAR vector | 44 | scFv VH CLDN6-CAR-4 | 144 | CAR 1 of MUC1-2-A-IRES-hCD19-B | 210 |
| BCMA CAR vector | 45 | SIGLEC-15-CAR-1 | 145 | CAR 2 of MUC1-2-A-IRES-hCD19-B | 219 |
| VL anti-CD5 | 46 | scFv SIGLEC-15-CAR-1 | 146 | Construct of MUC1-2-B-IRES-hCD19-B | 224 |
| VH anti-CD5 | 47 | scFv VL SIGLEC-15-CAR-1 | 147 | CAR 1 of MUC1-2-B-IRES-hCD19-B | 212 |
| VL anti-CD4 | 48 | scFv VH SIGLEC-15-CAR-1 | 148 | CAR 2 of MUC1-2-B-IRES-hCD19-B | 219 |
| VH anti-CD4 | 49 | VL1 VH1 SIGLEC-15-CAR-2 | 149 | Construct of MUC1-5E5-A-IRES-CD22-A | 225 |
| VL anti-CD3 | 50 | VL1 VH2 SIGLEC-15-CAR-3 | 150 | CAR 1 of MUC1-5E5-A-IRES-CD22-A | 202 |
| VH anti-CD3 | 51 | VL1 VH3 SIGLEC-15-CAR-4 | 151 | CAR 2 of MUC1-5E5-A-IRES-CD22-A | 226 |
| TSHR extracellular domain | 52 | VL1 VH 4 SIGLEC-15-CAR-5 | 52 | Construct of MUC1-5E5-B-IRES-CD22-A | 227 |
| VH region of BCMA scFv | 53 | VL2 VH 1 SIGLEC-15-CAR-6 | 153 | CAR 1 of MUC1-5E5-A-IRES-CD22-A | 205 |
| VL region of BCMA scFv | 54 | VL2 VH2 SIGLEC-15-CAR-7 | 154 | CAR 2 of MUC1-5E5-A-IRES-CD22-A | 226 |
| VH region of CD14 scFv | 55 | VL2 VH3 SIGLEC-15-CAR-8 | 155 | Construct of MUC1-5E5-A-IRES-CD22-B | 228 |
| VL region of CD14 scFv | 56 | VL2 VH4 SIGLEC-15-CAR-9 | 156 | MUC1-5E5-A-IRES-CD22-B CAR 1 | 202 |
| VH region of CD33 scFv | 57 | VL1 SIGLEC-15-CAR | 157 | MUC1-5E5-A-IRES-CD22-B CAR 2 | 229 |
| VL region of CD33 scFv | 58 | VL2 SIGLEC-15-CAR | 158 | MUC1-5E5-B-IRES-CD22-B | 230 |
| CD22CAR | 59 | VH1 SIGLEC-15-CAR | 159 | CAR 1 of MUC1-5E5-B-IRES-CD22-B | 205 |
| BCMACAR | 60 | VH2 SIGLEC-15-CAR | 160 | CAR 2 of MUC1-5E5-B-IRES-CD22-B | 229 |
| MUC1CAR | 61 | VH3 SIGLEC-15-CAR | 161 | Construct of MUC1-2-A-IRES-CD22-A | 231 |
| m19CAR-IRES-MUC1CAR | 62 | VH4 SIGLEC-15-CAR | 162 | CAR 1 of MUC1-2-A-IRES-CD22-A | 210 |
| hCD19CAR-IRES-MUC1CAR | 63 | MUC16-CAR-1 | 163 | CAR 2 of MUC1-2-A-IRES-CD22-A | 226 |
| hCD22CAR-IRES-MUC1CAR | 64 | scFv MUC16-CAR-1 | 164 | MUC1-2-B-IRES-CD22-A | 232 |
| BCMACAR-IRES-MUC1CAR | 65 | scFv VL MUC16-CAR-1 | 165 | MUC1-2-B-IRES-CD22-A CAR 1 | 212 |
| mCD19CAR-2A-MUC1CAR | 66 | scFv VH MUC16-CAR-1 | 166 | MUC1-2-B-IRES-CD22-A CAR 2 | 226 |
| hCD19CAR-2A-MUC1CAR | 67 | MUC16-CAR-2 | 167 | MUC1-2-A-IRES-CD22-B | 233 |
| hCD22CAR-2A-MUC1CAR | 68 | scFv MUC16-CAR-2 | 168 | MUC1-2-A-IRES-CD22-B CAR 1 | 210 |
| BCMA-2A-MUC1CAR | 69 | scFv VL MUC16-CAR-2 | 169 | MUC1-2-A-IRES-CD22-B CAR 2 | 229 |
| Tumor associated MUC1 scFv 1 | 70 | scFv VH MUC16-CAR-2 | 170 | Construct of MUC1-2-B-IRES-CD22-B | 234 |
| Tumor associated MUC1 scFv-1 VH | 71 | KISS1R-CAR | 171 | CAR 1 of MUC1-2-B-IRES-CD22-B | 212 |
| Tumor associated MUC1 scFv-1 VL | 72 | Ligent peptide KISS1R-CAR | 172 | CAR 2 of MUC1-2-B-IRES-CD22-B | 229 |

TABLE 2-continued

| Name | SEQ ID NO: | Name | SEQ ID NO: | Name | SEQ ID NO: |
|---|---|---|---|---|---|
| Tumor associated MUC1 scFv-1 VL CDR 1 | 73 | ZFLm1 (left) RS aa | 173 | Construct of MUC1-5E5-A-IRES-CD14-A | 235 |
| L2D8-2 (hCAR VL) | 74 | ZFLm1 (left) F1 | 174 | CAR 1 of MUC1-5E5-A-IRES-CD14-A | 202 |
| Tumor associated MUC1 scFv-1 VL CDR 3 | 75 | ZFLm1 (left) F2 | 174 | CAR 2 of MUC1-5E5-A-IRES-CD14-A | 236 |
| Tumor associated MUC1 scFv-1 VH CDR 1 | 76 | ZFLm1 (left) F3 | 176 | Construct of MUC1-5E5-B-IRES-CD14-A | 237 |
| Tumor associated MUC1 scFv-1 VH CDR 2 | 77 | ZFLm1 (left) F4 | 177 | CAR 1 of MUC1-5E5-B-IRES-CD14-A | 205 |
| Tumor associated MUC1 scFv-1 VH CDR 3 | 78 | ZFLm1 (left) F5 | 178 | CAR 2 of MUC1-5E5-B-IRES-CD14-A | 236 |
| Tumor associated MUC1 scFv 2 | 79 | ZFLm1 (left) F6 | 179 | Construct of MUC1-5E5-A-IRES-CD14-B | 238 |
| Tumor associated MUC1 scFv2 VH | 80 | ZFRm1-4 (right) RS aa | 180 | CAR 1 of MUC1-5E5-A-IRES-CD14-B | 202 |
| Tumor associated MUC1 scFv2 VL | 81 | ZFRm1-4 (right) F1 | 181 | CAR 2 of MUC1-5E5-A-IRES-CD14-B | 239 |
| Tumor associated MUC1 scFv-2 VL CDR 1 | 82 | ZFRm1-4 (right) F2 | 182 | Construct of MUC1-2-A-IRES-CD14-A | 240 |
| Tumor associated MUC1 scFv-2 VL CDR 2 | 83 | ZFRm1-4 (right) F3 | 184 | CAR 1 of MUC1-2-A-IRES-CD14-A | 210 |
| Tumor associated MUC1 scFv-2 VL CDR 3 | 84 | ZFRm1-4 (right) F4 | 184 | CAR 2 of MUC1-2-A-IRES-CD14-A | 236 |
| `Tumor associated MUC1 scFv-2VH CDR 1 | 85 | δ chain-1 of Vγ9Vδ2 | 185 | Construct of MUC1-2-B-IRES-CD14-A | 241 |
| Tumor associated MUC1 scFv-2 VH CDR 2 | 86 | γ chain-2 of Vγ9Vδ2 | 186 | CAR 1 of MUC1-2-B-IRES-CD14-A | 212 |
| Tumor associated MUC1 scFv-2 VH CDR 3 | 87 | δ chain-2 of Vγ9Vδ2 | 187 | CAR 2 of MUC1-2-B-IRES-CD14-A | 236 |
| GSTA motif | 88 | Vγ9Vδ2 TCR-1: DG.SF13 γ chain | 188 | Construct of MUC1-2-A-IRES-CD14-B | 242 |
| Modified PD-1 intracellular domain -1 | 89 | Vγ9Vδ2 TCR-1: DG.SF13 δ chain | 189 | CAR 1 of MUC1-2-A-IRES-CD14-B | 210 |
| Modified PD-1 intracellular domain -2 | 90 | Vγ9Vδ2 TCR-2: DG.SF68: γ chain | 190 | CAR 2 of MUC1-2-A-IRES-CD14-B | 239 |
| Modified PD-1 intracellular domain -3 | 91 | Vγ9Vδ2 TCR-2: DG.SF68: δ chain | 191 | Construct of MUC1-2-B-IRES-CD14-B | 243 |
| Modified PD-1 intracellular domain -4 | 92 | Vγ9Vδ2 TCR-3: 12G12: γ chain | 192 | CAR 1 of MUC1-2-B-IRES-CD14-B | 212 |
| Modified PD-1 intracellular domain -5 | 93 | Vγ9Vδ2 TCR-3: 12G12: δ chain | 193 | CAR 2 of MUC1-2-B-IRES-CD14-B | 239 |
| Removed PD-1 intracellular domain -1 | 94 | Vγ9Vδ2 TCR-4: CP.1.15 γ chain | 194 | Construct of MUC1-5E5-A-IRES-BCMA-A | 244 |
| Removed PD-1 intracellular domain -2 | 95 | TCR-4: CP.1.15δ chain | 195 | CAR 1 of MUC1-5E5-A-IRES-BCMA-A | 202 |
| FokI WC | 96 | WT CD3-zeta | 196 | CAR 2 of MUC1-5E5-A-IRES-BCMA-A | 245 |
| M FokI | 97 | Invariant sequence for iNKT α chain (hVα24-JαQ-TRAC) | 197 | Construct of MUC1-5E5-B-IRES-BCMA-A | 246 |
| M FokI | 98 | An example for iNKT β chain sequence (containing Vβ11): | 198 | CAR 1 of MUC1-5E5-B-IRES-BCMA-A | 205 |

TABLE 2-continued

| Name | SEQ ID NO: | Name | SEQ ID NO: | Name | SEQ ID NO: |
|---|---|---|---|---|---|
| γ chain-1 of Vγ9Vδ2 | 99 | Invariant sequence for MAIT α chain (hAV7S2-AJ33 α chain) (version1) | 199 | CAR 2 of MUC1-5E5-B-IRES-BCMA-A | 245 |
| VL anti-CD4-2 | 100 | VH anti-CD4-2 | 200 | Construct of MUC1-5E5-A-IRES-BCMA-B | 247 |
| CAR 1 of MUC1-2-A-IRES-CD33-A | 210 | CAR 1 of MUC1-5E5-B-IRES-CD33-A | 205 | CAR 1 of MUC1-5E5-A-IRES-BCMA-B | 202 |
| CAR 2 of MUC1-2-A-IRES-CD33-A | 255 | CAR 2 of MUC1-5E5-B-IRES-CD33-A | 255 | CAR 2 of MUC1-5E5-A-IRES-BCMA-B | 248 |
| Construct of MUC1-2-B-IRES-CD33-A | 261 | Construct of MUC1-5E5-A-IRES-CD33-B | 257 | Construct of MUC1-5E5-B-IRES-BCMA-B | 249 |
| CAR 1 of MUC1-2-B-IRES-CD33-A | 212 | CAR 1 of MUC1-5E5-A-IRES-CD33-B | 202 | CAR 1 of MUC1-5E5-B-IRES-BCMA-B | |
| CAR 2 of MUC1-2-B-IRES-CD33-A | 255 | CAR 2 of MUC1-5E5-A-IRES-CD33-B | 258 | CAR 2 of MUC1-5E5-B-IRES-BCMA-B | |
| Construct of MUC1-2-A-IRES-CD33-B | 262 | Construct of MUC1-5E5-B-IRES-CD33-B | 259 | Construct of MUC1-2-A-IRES-BCMA-A | 250 |
| CAR 1 of MUC1-2-A-IRES-CD33-B | 210 | CAR 1 of MUC1-5E5-B-IRES-CD33-B | 205 | CAR 1 of MUC1-2-A-IRES-BCMA-A | 210 |
| CAR 2 of MUC1-2-A-IRES-CD33-B | 258 | CAR 2 of MUC1-5E5-B-IRES-CD33-B | 258 | CAR 2 of MUC1-2-A-IRES-BCMA-A | 245 |
| Construct of MUC1-2-B-IRES-CD33-B | 263 | Construct of MUC1-2-A-IRES-CD33-A | 260 | Construct of MUC1-2-B-IRES-BCMA-A | 251 |
| CAR 1 of MUC1-2-B-IRES-CD33-B | 212 | Construct of MUC1-2-B-IRES-BCMA-B | 253 | CAR 1 of MUC1-2-B-IRES-BCMA-A | 212 |
| CAR 2 of MUC1-2-B-IRES-CD33-B | 258 | CAR 1 of MUC1-2-B-IRES-BCMA-B | 212 | CAR 2 of MUC1-2-B-IRES-BCMA-A | 245 |
| Construct of MUC1-5E5-A-IRES-CD33-A | 254 | MUC1-2-B-IRES-BCMA-B CAR 2 | 248 | Construct of MUC1-2-A-IRES-BCMA-B | 252 |
| CAR 1 of MUC1-5E5-A-IRES-CD33-A | 202 | MUC1-5E5-B-IRES-CD33-A | 256 | CAR 1 of MUC1-2-A-IRES-BCMA-B | 210 |
| CAR 2 of MUC1-5E5-A-IRES-CD33-A | 255 | CAR 2 of MUC1-2-A-IRES-BCMA-B | 248 | MUC1-5e5Panko-enhanced scFc | 264 |
| MUC1-Panko5e5-enhanced scFc | 265 | hinge and/or transmembrane domain A | 266 | hinge and/or transmembrane domain B | 267 |
| hinge and/or transmembrane domain C | 268 | hinge and/or transmembrane domain D | 269 | MUC1-5e5Panko-enhanced scFc A 41BB CD2 zeta | 270 |
| MUC1-5e5Panko-enhanced scFc B 41BB CD2 zeta | 271 | MUC1-5e5Panko-enhanced scFc C 41BB CD2 zeta | 272 | MUC1-5e5Panko-enhanced scFc D 41BB CD2 zeta | 273 |
| MUC1-Panko5e5-enhanced scFc A 41BB CD2 zeta | 274 | MUC1-Panko5e5-enhanced scFc B 41BB CD2 zeta | 275 | MUC1-Panko5e5-enhanced scFc C 41BB CD2 zeta | 276 |
| MUC1-Panko5e5-enhanced scFc D 41BB CD2 zeta | 277 | GS linker | 278 | Construct of TSHR CAR | 279 |
| CD8a Hinge & transmembrane | 280 | IL-17C Nucleic acid Sequence | 296 | IL12- IgG4 Hinge & CD8a transmembrane | 313 |
| CD8a transmembrane | 281 | IL-17C aa Sequence | 297 | IL12Rβ2 cytoplasmic | 314 |
| IgG4 Hinge & CD8a transmembrane | 282 | IL-17D Nucleic acid Sequence | 298 | IL18R1 cytoplasmic | 315 |
| IL-2 Nucleic acid Sequence | 283 | IL-17D aa Sequence | 299 | IL23R cytoplasmic | 316 |
| IL-2 aa Sequence | 285 | IL-17F Nucleic acid Sequence | 300 | Gp130 (IL6ST) cytoplasmic | 317 |

TABLE 2-continued

| Name | SEQ ID NO: | Name | SEQ ID NO: | Name | SEQ ID NO: |
|---|---|---|---|---|---|
| IL-6 Nucleic acid Sequence | 286 | IL-17F aa Sequence | 301 | IL15Ra, cytoplasmic | 318 |
| IL-6 aa Sequence | 287 | IL-23A Nucleic acid Sequence | 302 | IL12Rβ1 cytoplasmic | 319 |
| IL-7 Nucleic acid Sequence | 288 | IL-23A aa Sequence | 303 | 41BB + cd3zeta + IL receptor cytoplasmic region | 320 |
| IL-7 aa Sequence | 289 | IL-18 Nucleic acid Sequence | 304 | scFv + hinge + transmembrane + 41BB + IL receptor cytoplasmic region + cd3zeta | 321 |
| IL-15 Nucleic acid Sequence | 290 | IL-18 aa Sequence | 305 | scFv + hinge + transmembrane + IL receptor cytoplasmic region + 41BB + cd3zeta | 322 |
| IL-15 aa Sequence | 291 | IL-12 αp35 Nucleic acid Sequence | 306 | 41BB promoter | 323 |
| IL-17A Nucleic acid Sequence | 292 | IL-12αp35 aa Sequence | 307 | CD25 enhancer + minimal TK promoter | 324 |
| IL-17A aa Sequence | 293 | IL-12βp40 Nucleic acid Sequence | 308 | CD69 enhancer + minimal TK promoter | 325 |
| IL-17B Nucleic acid Sequence | 294 | IL-12 βp40 aa Sequence | 309 | IFN-gamma promoter | 326 |
| IL-17B aa Sequence | 295 | Fusion IL-12 | 310 | 2A | 327 |
| Hypoxia promoter (example 2) Transcription factor binding sites. | 330 | Fusion IL-23 | 311 | IFN-γ | 328 |
| Hypoxia promoter (example 3) Transcription factor binding sites. | 331 | IL12- CD8a Hinge & transmembrane | 312 | hPDE5 | 329 |
| NFAT promoter (example 1) Transcription factor binding sites. | 332 | Hypoxia promoter (example 1) the minimal promoter | 338 | TNF-alpha | 347 |
| NFAT promoter (example 2) Transcription factor binding sites. | 333 | Hypoxia promoter (example 2) the minimal promoter | 339 | Lymphotoxin beta (TNF-C) | 348 |
| FOXP3 promoter (example 1) Transcription factor binding sites. | 334 | Hypoxia promoter (example 3) the minimal promoter | 340 | OX40L | 349 |
| Hypoxia promoter (example 1) Transcription factor binding sites. | 335 | NFAT promoter (example 1) the minimal promoter | 341 | CD154 | 350 |
| NFkB promoter (example 1) Transcription factor binding sites. | 336 | NFAT promoter (example 2) the minimal promoter | 342 | FasL | 351 |
| NFkB promoter (example 2) Transcription factor binding sites. | 337 | FOXP3 promoter (example 1) the minimal promoter | 343 | CD70 | 352 |
| CXCl1 | 364 | FOXP3 promoter (example 2) the minimal promoter | 344 | CD153 | 353 |

TABLE 2-continued

| Name | SEQ ID NO: | Name | SEQ ID NO: | Name | SEQ ID NO: |
|---|---|---|---|---|---|
| CXCL2 | 365 | NFkB promoter (example 1) the minimal promoter | 345 | 4-1BB ligand | 354 |
| CXCL3 | 366 | NFkB promoter (example 2) the minimal promoter | 346 | TRAIL | 355 |
| CXCL4 | 367 | CXCL11 | 374 | RANKL | 356 |
| CXCL5 | 368 | CXCL12 | 375 | TWEAK | 357 |
| CXCL6 | 369 | CXCL13 | 376 | APRIL | 358 |
| CXCL7 | 370 | CXCL14 | 377 | LIGHT | 359 |
| CXCL8 | 371 | CCL1 | 378 | NGF, | 360 |
| CXCL9 | 372 | CCL2 | 379 | TNFSF18 | 361 |
| CXCL10 | 373 | CCL3 | 380 | TNFSF15 | 362 |
| ICOS ligand | 405 | CCl3L1 | 381 | Ectodysplasin-A | 363 |
| CD80 | 406 | CCl4 | 382 | IL2 receptor CD | 415 |
| CD86 | 407 | CCl5 | 383 | IL6 receptor CD | 418 |
| scFv against PD1 | 408 | CCl7 | 384 | IL7 receptor CD | 421 |
| scFv against PDL1 | 409 | CCl8 | 385 | IL12 receptor CD | 424 |
| B7-H3 scFv 1 | 410 | CCl11 | 386 | IL15 receptor CD | 427 |
| B7-H3 scFv2 | 411 | CCL13 | 387 | IL21 receptor CD | 430 |
| B7-H3 scFv3 | 412 | CCL14 | 388 | IL23 receptor CD | 433 |
| IL2 receptor ED | 413 | CCL15 | 389 | CD4 TM | 434 |
| IL6 receptor ED | 416 | CCl16 | 390 | CD8 TM | 436 |
| IL7 receptor ED | 419 | CCL17 | 391 | CD27 TM | 438 |
| IL12 receptor ED | 422 | CCl18 | 392 | CD28 TM | 440 |
| IL15 receptor ED | 425 | CCL19 | 393 | CD137 TM | 442 |
| IL21 receptor ED | 428 | CCL20 | 394 | PD1 TM | 444 |
| IL23 receptor ED | 431 | CCL21 | 395 | PDL1 TM | 446 |
| IL2 receptor TM | 414 | CCL22 | 396 | CD4 CD | 435 |
| IL6 receptor TM | 417 | CCL23 | 397 | CD8 CD | 437 |
| IL7 receptor TM | 420 | CCL24 | 398 | CD27 CD | 439 |
| IL12 receptor TM | 423 | CCL25 | 399 | CD28 CD | 441 |
| IL15 receptor TM | 426 | CCL26 | 400 | CD137 CD | 443 |
| IL21 receptor TM | 429 | CCL27 | 401 | PD1 CD | 445 |
| IL23 receptor TM | 432 | CCL28 | 402 | PDL1 CD | 447 |
| IL2 | 448 | Lymphotactin | 403 | IL21 | 452 |
| IL7 | 449 | CX3CL1 | 404 | IL23 | 453 |
| IL12 | 450 | Hif VHL-interaction domain: Hif amino acid 344-417 | 457 | IL33 | 454 |
| IL15 | 451 | Hif amino acid 380-603 | 458 | TNFα | 455 |
| siglec-15 antigen 2 | 460 | siglec-15 antigen 1 | 459 | IFNγ point mutation | 456 |
| siglec-15 antigen 3 | 461 | siglec-15 antigen 6 | 464 | GS linker sequence | 467 |
| siglec-15 antigen 4 | 462 | siglec-15 antigen 7 | 465 | EA linker sequence | 468 |
| siglec-15 antigen 5 | 463 | siglec-15 antigen 8 | 466 | NFAT6x + minimal IL12 promoter | 469 |

TM: Transmembrane domain
CD: cytoplasmic domain
EM: Extracellular daemon

TABLE 3

| transcription factors | Expression Conditions or notes | Example of constructs |
|---|---|---|
| Hif1a | hypoxia-induced expression | Hif1a binding site + minimal promoter + CDS of IL |
| NFAT | transcription factor in immune response | NFAT binding site + minimal promoter + CDS of IL |
| FOXP3 | transcription factor in T-reg | FOXP3 binding site + minimal promoter + CDS of IL |
| NFkB | transcription factor in immune response | NFkB binding site + minimal promoter + CDS of IL |

TABLE 4

| isolated nucleic acid sequence | Nucleic Acid Construct using Encoded Peptides |
|---|---|
| 1 | CAR + P2A + IL + CD8a Hinge & transmembrane |
| 2 | CAR + P2A + IL + IgG4 Hinge & CH2CH3 & CD4 transmembrane |
| 3 | CAR + Hypoixa/NFAT/FOXP3/NFkB promoter + IL + CD8a Hinge & transmembrane |
| 4 | CAR + Hypoixa/NFAT/FOXP3/NFkB promoter + IL + CD8a IgG4Hinge & CH2CH3 & CD4 transmembrane |
| 5 | scFv + hinge + transmembrane + 41BB + cd3zeta + IL receptor cytoplasmic region |
| 6 | scFv + hinge + transmembrane + 41BB + IL receptor cytoplasmic region + cd3zeta |

TABLE 4-continued

| isolated nucleic acid sequence | Nucleic Acid Construct using Encoded Peptides |
|---|---|
| 7 | scFv + hinge + transmembrane + IL receptor cytoplasmic region + 41BB + cd3zeta |

EXEMPLARY EMBODIMENTS

The following are exemplary embodiments:
1. An isolated nucleic acid sequence comprising a first nucleic acid sequence and a second or an additional nucleic acid sequence, the first nucleic acid sequence encoding a chimeric antigen receptor (CAR), the second or additional nucleic acid sequence encoding one or more therapeutic agents. For example, the one or more therapeutic agents are or comprise of IL-2, IL-6, IL-7, IL-15, IL-17, IL-23, or a combination thereof.
2. An isolated nucleic acid sequence comprising a first nucleic acid sequence and a second or an additional nucleic acid sequence, the first nucleic acid sequence encoding a chimeric antigen receptor (CAR), the second or additional nucleic acid sequence encoding a therapeutic agent that is or comprises at least one of TNFRSF superfamily member receptor activation antibodies or membrane-bound forms thereof, TNFRSF superfamily member ligands or the membrane-bound form thereof, chemokines or membrane-bound forms thereof, antibodies to the chemokines, or antibodies to receptors of the chemokines or the membrane-bound forms thereof, and D28 family's ligands that correspond to the sequences in Table 2-4.
3. A population of CAR cells comprising the first nucleic acid sequence and the additional nucleic acid sequence of embodiments 1 or 2, wherein the CAR cells comprise lymphocyte, leukocyte, or PBMC.
4. The population of CAR cells of embodiment 3, wherein the CAR and the one or more therapeutic agents are produced in the form of a polyprotein, which is cleaved to generate separate CAR and therapeutic agent molecules.
5. The population of CAR cells of embodiment 4, wherein the polyprotein comprises a cleavable moiety between the CAR and the therapeutic agent, the cleavable moiety comprises a 2A peptide, the 2A peptide comprises P2A or T2A, and/or the CAR and the therapeutic agent are each constitutively expressed.
6. The population of CAR cells of embodiment 3, wherein the CAR cells comprise: a third nucleic acid sequence encoding a second or an additional CAR binding an antigen that is different from the CAR, or the second or additional CAR binding a solid tumor antigen, and the CAR binds an antigen of a white blood cell.
7. A pharmaceutical composition comprising the population of CAR cells of one of embodiments 3-6. The pharmaceutical composition is used to treat a patient having a solid tumor.
8. A method of inducing or causing a T cell response in a subject in need thereof and/or treating a tumor of the subject, the method comprising administering an effective amount of the composition of embodiment 7 to the subject.
9. A modified cell comprising one or more CARs, wherein the cell is engineered to express and secrete a therapeutic agent that is or comprises at least one of IL-2, IL-6, IL-7, IL-15, IL-17, and IL-23.
10. A method of inducing or causing or enhancing T cell response, treating cancer, or enhancing cancer treatment, the method comprising: administrating an effective amount of the composition of T cells comprising one or more CARs, wherein the cell is engineered to express and secrete one or more therapeutic agents. For example, the therapeutic agent is or comprises IL-2, IL-6, IL-7, IL-15, IL-17, IL-23, or a combination thereof and the T cell response is enhanced as compared to the administration of T cells that do not express or secrete the therapeutic agent.
11. A method of inducing or causing or enhancing T cell response, treating cancer, or enhancing cancer treatment, the method comprising: administering an effective amount of the composition of a population of T cells comprising a CAR; and administering an effective amount of one or more therapeutic agents. For example, the therapeutic agent is or comprises IL-2, IL-6, IL-7, IL-15, IL-17, IL-23, or a combination thereof, wherein the T cell response is enhanced as compared to the administration of CAR T cells without the administration of therapeutic agent.
12. The method of embodiment 11, wherein administering an effective amount of the therapeutic agent comprises intravenous delivery of an amount of human IL-6 in the range of about 0.5-50 ug per kilogram of body weight.
13. The modified cell or the method of one of embodiments 9-12, wherein the T cell comprises a second or an additional CAR binding a solid tumor antigen, and the first CAR binds an antigen of a white blood cell.
14. The modified cell or the method of embodiment 13, wherein the solid tumor antigen is tMUC 1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Rα2, Mesothelin, PSMA, ROR1, VEGFR-II, GD2, FR-α, ErbB2, EpCAM, EGFRvIII, PSCA, or EGFR, and the B cell antigen is CD19, CD20, CD22, or BCMA.
15. The isolated nucleic acid sequence, the modified cell, or the method of any one of embodiments 2-14, wherein the therapeutic agent is IL-6 or IL-7.
16. The isolated nucleic acid sequence, the modified cell, or the method of any one of embodiments 2-14, wherein the CAR comprises an extracellular domain, a transmembrane domain, and an intracellular domain, the extracellular domain binding an antigen.
17. The isolated nucleic acid sequence, the modified cell, or the method of embodiment 16, wherein the intracellular domain comprises a co-stimulatory domain that comprises an intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof.
18. The isolated nucleic acid sequence, the modified cell, or the method of embodiment 17, wherein the antigen is Epidermal growth factor receptor (EGFR), Variant III of the epidermal growth factor receptor (EGFRvIII), Human epidermal growth factor receptor 2 (HER2), Mesothelin (MSLN), Prostate-specific membrane antigen (PSMA), Carcinoembryonic antigen (CEA), Disialoganglioside 2 (GD2), Interleukin-13Ra2 (IL13Rα2), Glypican-3 (GPC3), Carbonic anhydrase IX (CAIX), L1 cell adhesion molecule (L1-CAM), Cancer antigen 125 (CA125), Cluster of differentiation 133 (CD133), Fibroblast activation protein (FAP), Cancer/testis antigen 1B (CTAG1B), Mucin 1 (MUC1), Folate receptor-α (FR-α), CD19, FZD10, TSHR, PRLR, Muc 17, GUCY2C, CD207, CD3, CD5, B-Cell Maturation Antigen (BCMA), or CD4.

19. The isolated nucleic acid sequence, the modified cell, or the method of any one of embodiments 2-18, wherein the modified cell or T cells comprise a dominant negative PD-1 mutant such that PD-1/PDl-1 signaling pathway of the cell is interfered.

20. The isolated nucleic acid sequence, the modified cell, or the method of any one of embodiments 2-19, wherein the nucleic acid sequence encoding the therapeutic agent is present in the modified cell in a recombinant DNA construct, in an mRNA, or in a viral vector.

21. The isolated nucleic acid sequence, the modified cell, or the method of any one of embodiments 2-19, wherein the modified cell comprises an mRNA encoding the therapeutic agent, wherein the mRNA is not integrated into the genome of the modified cell.

22. The isolated nucleic acid sequence, the modified cell, or the method of any one of embodiments 2-21, wherein the therapeutic agent corresponds to at least one of sequence listed in Table 2.

23. The isolated nucleic acid sequence, the modified cell, or the method of any one of embodiments 2-21, wherein the modified cell comprises a nucleic acid sequence comprising a promoter comprising a binding site for a transcription modulator that modulates the expression of the therapeutic agent in the cell.

24. The isolated nucleic acid sequence, the modified cell, or the method of embodiment 23, wherein the transcription modulator is or includes Hif1a, N FAT, FOXP3, and/or NFkB.

25. The isolated nucleic acid sequence, the modified cell, or the method of embodiment 24, wherein the promoter is responsive to the transcription modulator.

26. The isolated nucleic acid sequence, the modified cell, or the method of embodiment 25, wherein the promoter is operably linked to the nucleic acid sequence encoding the therapeutic agent such that the promoter drives expression of the therapeutic agent in the cell.

27. The isolated nucleic acid sequence, the modified cell, or the method of embodiment 23, wherein the promoter and the binding site correspond to the sequences listed in Table 2-4.

28. An isolated nucleic acid sequence comprising a first nucleic acid sequence and a second nucleic acid sequence, the first nucleic acid sequence encoding a chimeric antigen receptor (CAR), the second nucleic acid sequence encoding a therapeutic agent and a transmembrane domain such that the therapeutic agent is associated or bound to cell membrane. Examples of the isolated nucleic acid sequence are listed in Table 4 (1-4)

29. A modified cell comprising the isolated nucleic acid sequence of embodiment 28.

30. A pharmaceutical composition comprising the population of the cells of embodiment 3.

31. A method of inducing or causing T cell response in a subject in need thereof and/or treating a tumor of the subject, the method comprising administering an effective amount of the composition of embodiment 30 to the subject.

32. A modified cell comprising a first nucleic acid sequence encoding a CAR, and a second nucleic acid sequence encoding a therapeutic agent and a transmembrane domain such that the therapeutic agent is associated or bound to the membrane of the modified cell.

33. The modified cell of one of embodiments 29-32, wherein the therapeutic agent is a cytokine.

34. The modified cell of embodiment 33, wherein the cytokine comprises multiple submits, the second nucleic acid encodes the multiple subunits, one or more linkers connecting the multiple subunits, and the transmembrane domain.

35. The modified cell of embodiment 33, wherein the second nucleic acid sequence comprises a nucleic acid sequence of or encodes an amino acid sequence of SEQ ID NO: 280-313.

36. The modified cell of embodiment 33, wherein the cytokine is or comprises at least one of IL-2, IL-6, IL-7, IL-12, IL-15, IL-17, IL-18, and IL-23.

37. The modified cell of any one of embodiments 29-36, wherein the CAR comprises an extracellular domain, a transmembrane domain, and an intracellular domain, wherein the extracellular domain binds an antigen.

38. The modified cell of embodiment 37, wherein the intracellular domain comprises a co-stimulatory domain that comprises an intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof.

39. The modified cell of embodiment 37, wherein the antigen is Epidermal growth factor receptor (EGFR), Variant III of the epidermal growth factor receptor (EGFRvIII), Human epidermal growth factor receptor 2 (HER2), Mesothelin (MSLN), Prostate-specific membrane antigen (PSMA), Carcinoembryonic antigen (CEA), Disialoganglioside 2 (GD2), Interleukin-13Ra2 (IL13Rα2), Glypican-3 (GPC3), Carbonic anhydrase IX (CAIX), L1 cell adhesion molecule (L1-CAM), Cancer antigen 125 (CA125), Cluster of differentiation 133 (CD133), Fibroblast activation protein (FAP), Cancer/testis antigen 1B (CTAG1B), Mucin 1 (MUC1), Folate receptor-α (FR-α), CD19, FZD10, TSHR, PRLR, Muc 17, GUCY2C, CD207, CD3, CD5, B-Cell Maturation Antigen (BCMA), or CD4.

40. The modified cell of one of embodiments 29-39, wherein the second nucleic acid sequence comprises a promoter comprising a binding site for a transcription modulator that modulates the expression of the therapeutic agent in the cell.

41. The modified cell of embodiment 40, wherein the transcription modulator is or includes Hif1a, NFAT, FOXP3, and/or NFkB.

42. A method of inducing or causing or enhancing T cell response, treating cancer, or enhancing cancer treatment, the method comprising: administrating an effective amount of the composition of the modified cells of one of embodiments 29-41.

43. An isolated nucleic acid sequence encoding a binding molecule comprising an extracellular domain, a transmembrane domain, and an intracellular domain, the extracellular domain binds an antigen, the intracellular domain comprising a cytoplasmic domain of a receptor of a therapeutic agent. Examples of the isolated nucleic acid sequence are listed in Table 4 (5-8)

44. A cell comprising the isolated nucleic acid sequence of embodiment 43.

45. A pharmaceutical composition comprising the population of the cells of embodiment 44.

46. A method of inducing or causing T cell response in a subject in need thereof and/or treating a tumor of the subject, the method comprising administering an effective amount of the composition of embodiment 45 to the subject.

47. A modified cell comprising a binding molecule comprising an extracellular domain, a transmembrane domain, and an intracellular domain, the extracellular domain binds an antigen, the intracellular domain comprising a cytoplasmic domain of a therapeutic agent.

48. The isolated nucleic acid sequence and the modified cell of any one of embodiments 43-47, wherein the therapeutic agent is a cytokine.

49. The isolated nucleic acid sequence and the modified cell of any one of embodiments 43-47, wherein the receptor of the therapeutic agent is or comprises IL12Rβ2, IL18R1, IL123R, GP130, IL15Ra, or IL12Rβ1.

50. The isolated nucleic acid sequence and the modified cell of any one of embodiments 43-47, wherein the therapeutic agent is or comprises IL12, IL18, IL123, IL-6, or IL-15.

51. The isolated nucleic acid sequence and the modified cell of any one of embodiments 43-47, wherein the cytoplasmic domain is or comprises at least one of the amino acid sequences of SEQ ID Nos: 314-319.

52. The isolated nucleic acid sequence and the modified cell of any one of embodiments 43-47, wherein the modified cell comprises the isolated nucleic acid sequence comprising any one of the amino acid sequences of SEQ ID Nos: 320-322.

53. The isolated nucleic acid sequence and the modified cell of any one of embodiments 43-51, wherein the modified cell comprises an additional nucleic acid sequence, the isolated nucleic acid sequence comprises additional nucleic acid sequence, and the additional nucleic acid sequence comprises 41-BB domain and CD3 Zeta domain, a nucleic acid sequence encoding the cytoplasmic domain is located between the 41-BB domain and CD3 zeta domain.

54. The isolated nucleic acid sequence and the modified cell of any one of embodiments 43-51, wherein the modified cell comprises an additional nucleic acid sequence, the isolated nucleic acid sequence comprises additional nucleic acid sequence, and the additional nucleic acid sequence comprises 41-BB domain and CD3 Zeta domain, a nucleic acid sequence encoding the cytoplasmic domain is located before the 41-BB domain ordered from a N-terminal of the cytoplasmic domain.

55. The isolated nucleic acid sequence and the modified cell of any one of embodiments 43-51, wherein the modified cell comprises an additional nucleic acid sequence, the isolated nucleic acid sequence comprises additional nucleic acid sequence, and the additional nucleic acid sequence comprises 41-BB domain and CD3 Zeta domain, a nucleic acid sequence encoding the cytoplasmic domain is located after the CD3 Zeta domain ordered from a N-terminal of the cytoplasmic domain.

56. The isolated nucleic acid sequence and the modified cell of any one of embodiments 43-55, wherein the intracellular domain comprises a co-stimulatory domain that comprises an intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof.

57. The isolated nucleic acid sequence and the modified cell of embodiment 56, wherein the antigen is Epidermal growth factor receptor (EGFR), Variant III of the epidermal growth factor receptor (EGFRvIII), Human epidermal growth factor receptor 2 (HER2), Mesothelin (MSLN), Prostate-specific membrane antigen (PSMA), Carcinoembryonic antigen (CEA), Disialoganglioside 2 (GD2), Interleukin-13Ra2 (IL13Rα2), Glypican-3 (GPC3), Carbonic anhydrase IX (CAIX), L1 cell adhesion molecule (L1-CAM), Cancer antigen 125 (CA125), Cluster of differentiation 133 (CD133), Fibroblast activation protein (FAP), Cancer/testis antigen 1B (CTAG1B), Mucin 1 (MUC1), Folate receptor-α (FR-α), CD19, FZD10, TSHR, PRLR, Muc 17, GUCY2C, CD207, CD3, CD5, B-Cell Maturation Antigen (BCMA), or CD4.

58. The modified cell or the cell of any one of embodiments 44-57, wherein a signaling pathway is activated when the binding molecule binds to the antigen.

59. An isolated nucleic acid sequence comprising a nucleic acid sequence and an additional nucleic acid sequence, the nucleic acid sequence encoding a chimeric antigen receptor (CAR), the additional nucleic acid sequence encoding a therapeutic agent that is or comprises at least one of IL-2, IL-6, IL-7, IL-15, IL-17, and IL-23.

60. An isolated nucleic acid sequence comprising a nucleic acid sequence and an additional nucleic acid sequence, the nucleic acid sequence encoding a chimeric antigen receptor (CAR), the additional nucleic acid sequence encoding a therapeutic agent that is or comprises at least one of TNFRSF superfamily member receptor activation antibodies or membrane-bound forms thereof, TNFRSF superfamily member ligands or the membrane-bound form thereof, chemokines or membrane-bound forms thereof, antibodies to the chemokines, or antibodies to receptors of the chemokines or the membrane-bound forms thereof, and D28 family's ligands that correspond to the sequences in Table 2-4.

61. A population of CAR cells comprising the nucleic acid sequence and the additional nucleic acid sequence of embodiments 59 or 60, wherein the CAR cells comprise lymphocyte, leukocyte, or PBMC.

62. The population of CAR cells of embodiment 61, wherein the CAR and the therapeutic agent are produced in the form of a polyprotein, which is cleaved to generate separate CAR and therapeutic agent molecules.

63. The population of CAR cells of embodiment 62, wherein the polyprotein comprises a cleavable moiety between the CAR and the therapeutic agent, the cleavable moiety comprises a 2A peptide, the 2A peptide comprises P2A or T2A, and/or the CAR and the therapeutic agent are each constitutively expressed.

64. The population of CAR cells of embodiment 61, wherein the CAR cells comprise: a third nucleic acid sequence encoding an additional CAR binding to an antigen that is different from the CAR, or
the additional CAR binding a solid tumor antigen, and the CAR binds an antigen of a white blood cell.

65. A pharmaceutical composition comprising the population of the CAR cells of one of embodiments 61-64.

66. A method of causing T cell response in a subject in need thereof and/or treating a tumor of the subject, the method comprising administering an effective amount of the composition of embodiment 65 to the subject.

67. A modified cell comprises one or more CARs, wherein the cell is engineered to express and secrete a therapeutic agent that is or comprises at least one of IL-2, IL-6, IL-7, IL-15, IL-17, and IL-23.

68. A method of causing or enhancing T cell response, treating cancer, or enhancing cancer treatment, the method comprising: administrating an effective amount of the composition of T cells comprising one or more CARs, wherein the cell is engineered to express and secrete a therapeutic agent that is or comprises at least one of IL-2, IL-6, IL-7, IL-15, IL-17, and IL-23, and the T cell response is enhanced as compared to the administration of T cells that do not express or secrete the therapeutic agent.

69. A method of causing or enhancing T cell response, treating cancer, or enhancing cancer treatment, the method comprising:

administering an effective amount of the composition of a population of T cells comprising a CAR; and
administering an effective amount of a therapeutic agent that is or comprises at least one of IL-2, IL-6, IL-7, IL-15, IL-17, and IL-23, wherein the T cell response is enhanced as compared to the administration of CAR T cells without the administration of therapeutic agent.

70. The method of embodiment 69, wherein the administering the effective amount of the therapeutic agent comprises intravenous delivery of an amount of human IL-6 in the range of about 0.5-50 ug per kilogram of body weight.

71. The modified cell or the method of one of embodiments 67-70, wherein the T cell comprises an additional CAR binding a solid tumor antigen, and the CAR binds an antigen of a white blood cell.

72. The modified cell or the method of embodiment 71, wherein the solid tumor antigen is tMUC 1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Rα2, Mesothelin, PSMA, ROR1, VEGFR-II, GD2, FR-α, ErbB2, EpCAM, EGFRvIII, PSCA, or EGFR, and the B cell antigen is CD19, CD20, CD22, or BCMA.

73. The isolated nucleic acid sequence, the modified cell, or the method of any one of embodiments 60-72, wherein the therapeutic agent is IL-6 or IL-7.

74. The isolated nucleic acid sequence, the modified cell, or the method of any one of embodiments 60-72, wherein the CAR comprises an extracellular domain, a transmembrane domain, and an intracellular domain, the extracellular domain binds an antigen.

75. The isolated nucleic acid sequence, the modified cell, or the method of embodiment 74, wherein the intracellular domain comprises a co-stimulatory domain that comprises an intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof.

76. The isolated nucleic acid sequence, the modified cell, or the method of embodiment 75, wherein the antigen is Epidermal growth factor receptor (EGFR), Variant III of the epidermal growth factor receptor (EGFRvIII), Human epidermal growth factor receptor 2 (HER2), Mesothelin (MSLN), Prostate-specific membrane antigen (PSMA), Carcinoembryonic antigen (CEA), Disialoganglioside 2 (GD2), Interleukin-13Ra2 (IL13Rα2), Glypican-3 (GPC3), Carbonic anhydrase IX (CAIX), L1 cell adhesion molecule (L1-CAM), Cancer antigen 125 (CA125), Cluster of differentiation 133 (CD133), Fibroblast activation protein (FAP), Cancer/testis antigen 1B (CTAG1B), Mucin 1 (MUC1), Folate receptor-α (FR-α), CD19, FZD10, TSHR, PRLR, Muc 17, GUCY2C, CD207, CD3, CD5, B-Cell Maturation Antigen (BCMA), or CD4.

77. The isolated nucleic acid sequence, the modified cell, or the method of any one of embodiments 60-76, wherein the modified cell or T cells comprise a dominant negative PD-1 mutant such that PD-1/PDl-1 signaling pathway of the cell is interfered.

78. The isolated nucleic acid sequence, the modified cell, or the method of any one of embodiments 60-77, wherein the therapeutic agent is present in the modified cell in a recombinant DNA construct, in an mRNA, or in a viral vector.

79. The isolated nucleic acid sequence, the modified cell, or the method of any one of embodiments 60-77, wherein the modified cell comprises a therapeutic agent mRNA encoding the therapeutic agent, and the mRNA is not integrated into the genome of the modified cell.

80. The isolated nucleic acid sequence, the modified cell, or the method of any one of embodiments 60-79, wherein the therapeutic agent corresponds to at least one of sequence listed in Table 2-4.

81. The isolated nucleic acid sequence, the modified cell, or the method of any one of embodiments 60-79, wherein the modified cell comprises a nucleic acid sequence comprising a promoter comprising a binding site for a transcription modulator that modulates the expression of the therapeutic agent in the cell.

82. The isolated nucleic acid sequence, the modified cell, or the method of embodiment 81, wherein the transcription modulator is or includes Hif1a, N FAT, FOXP3, and/or NFkB.

83. The isolated nucleic acid sequence, the modified cell, or the method of embodiment 82, wherein the promoter is responsive to the transcription modulator.

84. The isolated nucleic acid sequence, the modified cell, or the method of embodiment 83, wherein the promoter is operably linked to the nucleic acid sequence encoding the therapeutic agent such that the promoter drives expression of the therapeutic agent in the cell.

85. The isolated nucleic acid sequence, the modified cell, or the method of embodiment 81, wherein the promoter and the binding site correspond to the sequences listed in Table 2-4.

86. A modified cell comprises one or more CARs, wherein the cell is engineered to express and secrete a therapeutic agent such as a cytokine.

87. A method of causing or enhancing T cell response, treating cancer, or enhancing cancer treatment, the method comprising: administrating an effective amount of the composition of T cells comprising one or more CARs, wherein the cell is engineered to express and secrete a therapeutic agent such as a cytokine.

88. The modified cell or the method of one of embodiments 86-87, wherein the therapeutic agent that is or comprises IFN-γ.

89. The modified cell or the method of one of embodiments 86-88, wherein the therapeutic agent that is or comprises IL-6 or IFN-γ, or a combination thereof. For example, the therapeutic agent may comprise SEQ ID NO: 287 or 328.

90. The modified cell or the method of one of embodiments 86-89, wherein the therapeutic agent that is or comprises IL-15 or IL-12, or a combination thereof.

91. The modified cell or the method of one of embodiments 86-90, wherein the small protein or the therapeutic agent is or comprises a recombinant or native cytokine. 92. The modified cell or the method of one of embodiments 86-91, wherein the therapeutic agent comprises a FC fusion protein associated with a small protein.

93. The modified cell or the method of one of embodiments 86-92, wherein the small protein is or comprises IL-12, IL-15, IL-6 or IFN-γ.

94. The modified cell or the method of one of embodiments 86-93, wherein expression and/or secretion is regulated by a controlling system such as an inducible expression system, or the modified cell is regulated by an inducible suicide expression.

95. The modified cell or the method of one of embodiments 86-94, wherein the therapeutic agent activates macrophages and/or dendritic cells.

96. The modified cell or the method of one of embodiments 86-95, wherein the therapeutic agent causes macrophages to remove granulocytes.

97. The modified cell or the method of one of embodiments 86-96, wherein the therapeutic agent inhibits or suppresses growth of cancer cells.

98. The modified cell or the method of one of embodiments 86-97, wherein the therapeutic agent is or comprises a recombinant or a native protein.

99. The modified cell or the method of one of embodiments 86-98, wherein the modified cell comprises a modified programmed cell death protein 1 (PD-1) that is a dominant negative PD-1.

100. The modified cell or the method of one of embodiments 86-99, wherein the one or more CARs comprise a CAR targeting a tumor cell.

101. The modified cell or the method of one of embodiments 86-100, wherein the one or more CARs comprise a CAR binding a solid tumor antigen and an additional CAR binding a blood cell antigen such as a B cell antigen.

102. The modified cell or the method of one of embodiments 86-100, wherein the solid tumor antigen is tMUC 1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Rα2, Mesothelin, PSMA, ROR1, VEGFR-II, GD2, FR-α, ErbB2, EpCAM, EGFRvIII, or EGFR, and the B cell antigen is CD19, CD20, CD22, or BCMA.

103. The modified cell or the method of one of embodiments 86-102, wherein the solid tumor antigen comprises B7, CAIX, CD123, CD133, CD171, CD171/L1-CAM, CEA, Claudin 18.2, cMet, CS1, CSPG4, Dectin1, EGFR, EGFR vIII, EphA2, ERBB receptors, ErbB T4, ERBB2, FAP, Folate receptor 1, FITC, Folate receptor 1, FSH, GD2, GPC3, HA-1 H/HLA-A2, HER2, IL-11Ra, IL13 receptor a2, IL13R, IL13Rα2 (zetakine), Kappa, Leukemia, LewisY, Mesothelin, MUC1, NKG2D, NY-ESO-1, PSMA, ROR-1, TRAIL-receptor1, or VEGFR2, and the B cell antigen is CD19, CD20, CD22, or BCMA.

104. The modified cell or the method of one of embodiments 86-103, wherein the T cell response is enhanced as compared to the administration of CAR T cells that do not express or secrete the therapeutic agent.

105. The modified cell or the method of one of embodiments 86-104, wherein the modified cell comprises a nucleic acid sequence encoding hTERT or a nucleic acid encoding SV40LT, or a combination thereof, wherein the nucleic acid sequence encoding hTERT or a nucleic acid encoding SV40LT, or a combination thereof is integrated into the genome of the modified T cell, and the modified T cell constitutively expresses hTERT, SV40LT, or a combination thereof.

106. The modified cell or the method of one of embodiments 86-105, wherein expression of the nucleic acid sequence encoding hTERT, a nucleic acid encoding SV40LT, or a combination thereof, is regulated by an inducible expression system, and/or the modified T cell comprises a nucleic acid sequence encoding a suicide gene.

107. The modified cell or the method of one of embodiments 86-106, wherein the modified cell is derived from a healthy donor or the subject.

108. The modified cell or the method of one of embodiments 86-107, wherein the TRAC gene of the modified cell is inactivated.

109. The modified cell or the method of one of embodiments 86-108, wherein the modified cell has a reduced graft-versus-host disease (GVHD) response in a bioincompatible human recipient as compared to the GVHD response of the primary human T cell in response to allogenic CAR T treatment.

110. The modified cell or the method of one of embodiments 86-109, wherein the modified cell has reduced amount PD-1 or has a dominant negative PD-1 such that an signaling pathway of the PD-1 is blocked.

111. The modified cell or the method of one of embodiments 86-110, wherein the modified cell has reduced amount PD-1 or has a dominant negative PD-1 such that an signaling pathway of the PD-1 is blocked, the therapeutic agent is IL-12 or IFN-γ, or a combination thereof.

112. The modified cell or the method of an embodiments 86-111, wherein the modified cell has reduced amount PD-1 or has a dominant negative PD-1 such that an signaling pathway of the PD-1 is blocked, the therapeutic agent comprises a CD40 agonist such as CP-870,893 from Pfizer.

113. The modified cell or the method of an embodiments 86-112, wherein the modified cell comprises an additional therapeutic agent, the modified cell comprises a nucleic acid sequence encoding the therapeutic agent and an additional nucleic acid sequence encoding the additional therapeutic agent, and the nucleic acid sequence and the additional nucleic acid sequence are connected by an IRES element or a third nucleic acid sequence encoding a 2A peptide.

114. The modified cell or the method of embodiment 113, wherein the therapeutic agent is IL-6, and the additional therapeutic agent is IFN-γ.

115. The modified cell or the method of embodiment 113, wherein the therapeutic agent is IL-12, and the additional therapeutic agent is IFN-γ.

116. The modified cell or the method of claim 113, wherein the therapeutic agent is CD40, and the additional therapeutic agent is IFN-γ.

117. The modified cell or the method of an embodiments 86-116, wherein the modified cell comprises a nucleic acid sequence comprising a promoter comprising a binding site for a transcription modulator that modulates the expression and/or secretion of the therapeutic agent in the cell.

118. The modified cell or the method of any one of embodiments 86-116, wherein the transcription modulator is or includes Hif1a, NFAT, FOXP3, and/or NFkB.

119. The modified cell or the method of embodiment 118, wherein the promoter is responsive to the transcription modulator.

120. The modified cell or the method of any one of embodiments 118-119, wherein the promoter is operably linked to the nucleic acid sequence encoding the therapeutic agent such that the promoter drives expression and/or secretion of the therapeutic agent in the cell.

121. The modified cell or the method of any one of embodiments 118-120, wherein the promoter comprises at least one of SEQ ID Nos: 323-325.

122. The modified cell or the method of any one of embodiments 86-120, wherein the modified cell comprises one or more nucleic acid sequences encoding a stimulus response element and encoding one or more CARs and/or the therapeutic agent, and the stimulus response element comprises at least one portion of the cGMP-specific 3',5'-cyclic phosphodiesterase or a molecule derived of, for example, SEQ ID NO: 329.

123. The modified cell or the method of embodiment 122, wherein expression of the one or more CARs and/or the therapeutic agent is ligand dependent.

124. The modified cell or the method of embodiment 122, wherein expressed the one or more CARs and/or the therapeutic agent are destabilized or degraded in the absence of a corresponding ligand.

125. The modified cell or the method of any one of embodiments 122-124, wherein modified cell comprises one or more nucleic acid sequences encoding at least one portion of the cGMP-specific 3',5'-cyclic phosphodiesterase or a molecule derived of, for example, SEQ ID NO: 329 appended to or associated with the therapeutic agent such that expression of the therapeutic agent is ligand dependent, and the therapeutic agent is or comprises IL6 or IFN-γ, or a combination thereof.

126. A fusion protein comprising a scFv binding PD-1 or PDL1, a linker, an extracellular domain, a transmembrane domain, and a cytoplasmic domain, wherein the transmembrane domain is selected from a group consist of a transmembrane domain of a receptor of IL15, IL2, IL7, IL6, IL12, IL18, IL21, IL23, IL 33, TNFα, TNFβ, IFNα, IFNγ, and IFNβ as well as siglec-15 antigen, and the cytoplasmic domain is selected from a group consist of a cytoplasmic domain of receptor of the receptor of IL15, IL2, IL7, IL6, IL12, IL18, IL21, IL23, IL 33, TNFα, TNFβ, IFNα, IFNγ, and IFNβ as well as siglec-15 antigen, and the extracellular domain is selected from a group consist of an extracellular domain of the receptor of IL15, IL2, IL7, IL6, IL12, IL18, IL21, IL23, IL 33, TNFα, TNFβ, IFNα, IFNγ, and IFNβ as well as siglec-15 antigen.

127. A fusion protein comprising a scFv binding PD-1 or PDL1, a linker, a transmembrane domain, and a cytoplasmic domain, wherein the transmembrane domain is selected from a group consist of a transmembrane domain of a receptor of CD4, CD8, CD28, CD27, CD25, CD137, PD1 and PDL1 as well as siglec-15 antigen, and the cytoplasmic domain is selected from a group consist of a cytoplasmic domain of receptor of the receptor of CD4, CD8, CD28, CD27, CD25, CD137, PD1 and PDL1 as well as siglec-15 antigen.

128. A fusion protein comprising a cytokine is selected from a group consist of IL15, IL2, IL7, IL6, IL12, IL18, IL21, IL23, IL 33, TNFα, TNFβ, IFNα, and IFNβ, a linker, an extracellular domain, a transmembrane domain, and a cytoplasmic domain, wherein the transmembrane domain is selected from a group consist of a transmembrane domain of the receptor of IL15, IL2, IL7, IL6, IL12, IL18, IL21, IL23, IL 33, TNFα, TNFβ, IFNα, IFNγ, and IFNβ as well as siglec-15 antigen, and the cytoplasmic domain is selected from a group consist of a cytoplasmic domain of receptor of the receptor of IL15, IL2, IL7, IL6, IL12, IL18, IL21, IL23, IL 33, TNFα, TNFβ, IFNα, and IFNβ, and the extracellular domain is selected from a group consist of an extracellular domain of the receptor of IL15, IL2, IL7, IL6, IL12, IL18, IL21, IL23, IL 33, TNFα, TNFβ, IFNα, and IFNβ.

129. A fusion protein comprising a cytokine is selected from a group consist of IL15, IL2, IL7, IL6, IL12, IL18, IL21, IL23, IL 33, TNFα, TNFβ, IFNα, and IFNβ, a linker, a transmembrane domain, and a cytoplasmic domain, wherein the transmembrane domain is selected from a group consist of a transmembrane domain of a receptor of CD4, CD8, CD28, CD27, CD25, CD137, PD1 and PDL1 as well as siglec-15 antigen, and the cytoplasmic domain is selected from a group consist of a cytoplasmic domain of receptor of the receptor of CD4, CD8, CD28, CD27, CD25, CD137, PD1 and PDL1 as well as siglec-15 antigen.

130. A fusion protein comprising a binding domain binding a ligand or a receptor of an immune checkpoint molecule and a docking molecule, wherein the immune checkpoint molecule is selected from the group consisting of programmed death 1 (PD-1), cytotoxic T lymphocyte antigen-4 (CTLA-4), B- and T-lymphocyte attenuator (BTLA), T cell immunoglobulin mucin-3 (TIM-3), lymphocyte-activation protein 3 (LAG-3), T cell immunoreceptor with Ig and ITIM domains (TIGIT), leukocyte-associated immunoglobulin-like receptor 1 (LAIR1), natural killer cell receptor 2B4 (2B4), VISTA (its receptor), and CD 160, and the docking molecule associates the binding domain with a cell.

131. The fusion protein of embodiment 130, wherein the docking molecule comprises a linker, a transmembrane domain, and a cytoplasmic domain.

132. The fusion protein of embodiment 131, wherein the transmembrane domain is selected from a group consist of a transmembrane domain of a receptor of IL15, IL2, IL7, IL6, IL12, IL18, IL21, IL23, IL 33, TNFα, TNFβ, IFNα, and IFNβ, and the cytoplasmic domain is selected from a group consist of a cytoplasmic domain of receptor of the receptor of IL15, IL2, IL7, IL6, IL12, IL18, IL21, IL23, IL 33, TNFα, TNFβ, IFNα, and IFNβ.

133. The fusion protein of embodiment 131, wherein the docking molecule further comprises an extracellular domain.

134. The fusion protein of embodiment 133, wherein the extracellular domain is selected from a group consist of an extracellular domain of the receptor of IL15, IL2, IL7, IL6, IL12, IL18, IL21, IL23, IL 33, TNFα, TNFβ, IFNα, and IFNβ.

135. The fusion protein of embodiment 130, wherein the docking molecule comprises a linker, a transmembrane domain, and a cytoplasmic domain.

136. The fusion protein of embodiment 135, wherein the transmembrane domain is selected from a group consist of a transmembrane domain of a receptor of CD4, CD8, CD28, CD27, CD25, CD137, PD1 and PDL1 as well as siglec-15 antigen, and the cytoplasmic domain is selected from a group consist of a cytoplasmic domain of receptor of the receptor of CD4, CD8, CD28, CD27, CD25, CD137, PD1 and PDL1 as well as siglec-15 antigen.

137. The fusion protein of one of embodiments 130-136, wherein the binding domain is a scFv.

138. The fusion protein of embodiment 130, wherein binding domain is a scFv binding CD80 or CD86.

139. The fusion protein of embodiment 138, wherein the docking molecule comprises or is wide type or modified CTLA4 or PD-1.

140. The fusion protein of embodiment 130, wherein binding domain is a scFv binding VISTA.

141. The fusion protein of embodiment 140, wherein the docking molecule comprises or is wide type or modified VISTA receptor or PD-1.

142. The fusion protein of embodiment 130, wherein the binding domain is a scFv binding PDL1 or PD1, and/or the docking molecule comprises or is wide type or modified PD-1.

143. The fusion protein of embodiment 130, wherein the binding domain is a scFv binding B7-H3.

144. The fusion protein of embodiment 143, wherein the docking molecule comprises or is wide type or modified B7-H3 receptor or PD-1.

145. A fusion protein comprising a therapeutic agent and a docking molecule, wherein the docking molecule comprises a cytoplasmic domain and a transmembrane domain that associate the therapeutic agent with a cell.

146. The fusion protein of embodiment 142, wherein the therapeutic agent comprises or is the binding domain of one of embodiment 5-20 or the cytokine of one of embodiments 3 and 4.

148. A nucleic acid sequence encoding the fusion protein of one of embodiments 1-22.

147 A modified cell comprises the fusion protein of one of embodiments 126-148 or the nucleic acid sequence of embodiment 23.

149. A pharmaceutical composition comprising the population of the modified cells of embodiment 24.

150. A method of cause T cell response in a subject in need thereof and/or treating a tumor of the subject, the method comprising administering an effective amount of the composition of embodiment 24 to the subject.

151. The pharmaceutical composition, the modified cell, and the method of one of embodiments 148-26, wherein the linker is a GS linker.

152. The pharmaceutical composition, the modified cell, and the method of one of embodiments 148-26, wherein the modified cell comprises a CAR.

153. The pharmaceutical composition, the modified cell, and the method of one of embodiments 148-26, wherein the CAR comprises an extracellular domain, a transmembrane domain, and an intracellular domain, the extracellular domain binds an antigen.

154. The pharmaceutical composition, the modified cell, and the method of one of embodiments 148-26, wherein the intracellular domain comprises a co-stimulatory domain that comprises an intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof.

155. The pharmaceutical composition, the modified cell, and the method of one of embodiments 148-26, wherein the antigen is Epidermal growth factor receptor (EGFR), Variant III of the epidermal growth factor receptor (EGFRvIII), Human epidermal growth factor receptor 2 (HER2), Mesothelin (MSLN), Prostate-specific membrane antigen (PSMA), Carcinoembryonic antigen (CEA), Disialoganglioside 2 (GD2), Interleukin-13Ra2 (IL13Rα2), Glypican-3 (GPC3), Carbonic anhydrase IX (CAIX), L1 cell adhesion molecule (L1-CAM), Cancer antigen 125 (CA125), Cluster of differentiation 133 (CD133), Fibroblast activation protein (FAP), Cancer/testis antigen 1B (CTAG1B), Mucin 1 (MUC1), Folate receptor-α (FR-α), CD19, FZD10, TSHR, PRLR, Muc 17, GUCY2C, CD207, CD3, CD5, B-Cell Maturation Antigen (BCMA), or CD4.

156. The pharmaceutical composition, the modified cell, and the method of one of embodiments 126-31, wherein the fusion protein is regulated by an inducible gene expression system.

157. A fusion protein comprising a cytokine and an oxygen-sensitive polypeptide domain.

158. The fusion protein of embodiment 157, wherein the oxygen-sensitive polypeptide domain is s HIFI alpha, HIF3 alpha, or a sequencing having an identity of over 80%, preferably 90% or more preferably 95% with respectively Hif VHL-interaction domain or Hif amino acid 344-417 Hif amino acid 380-603.

159. The fusion protein of embodiment 158, wherein the oxygen-sensitive polypeptide domain comprises HIF VHL binding domain.

160. The fusion protein of embodiment 157, wherein HIFI alpha is hydroxylated by HIF aspecific prolyl hydroxylases (PHDI-3) which are oxygen sensing. Hydroxylation triggers poly-ubiquitylation of HIF1 alpha and targets the latter for proteosomal degradation by an E3 ubiquitin ligase. In hypoxia (low 0 2), occur an inhibition of hydroxylation via TCA cycle intermediates, a stabilization of the HIFa protein and an impairment of HIF transcriptional activity.

Figure 5:
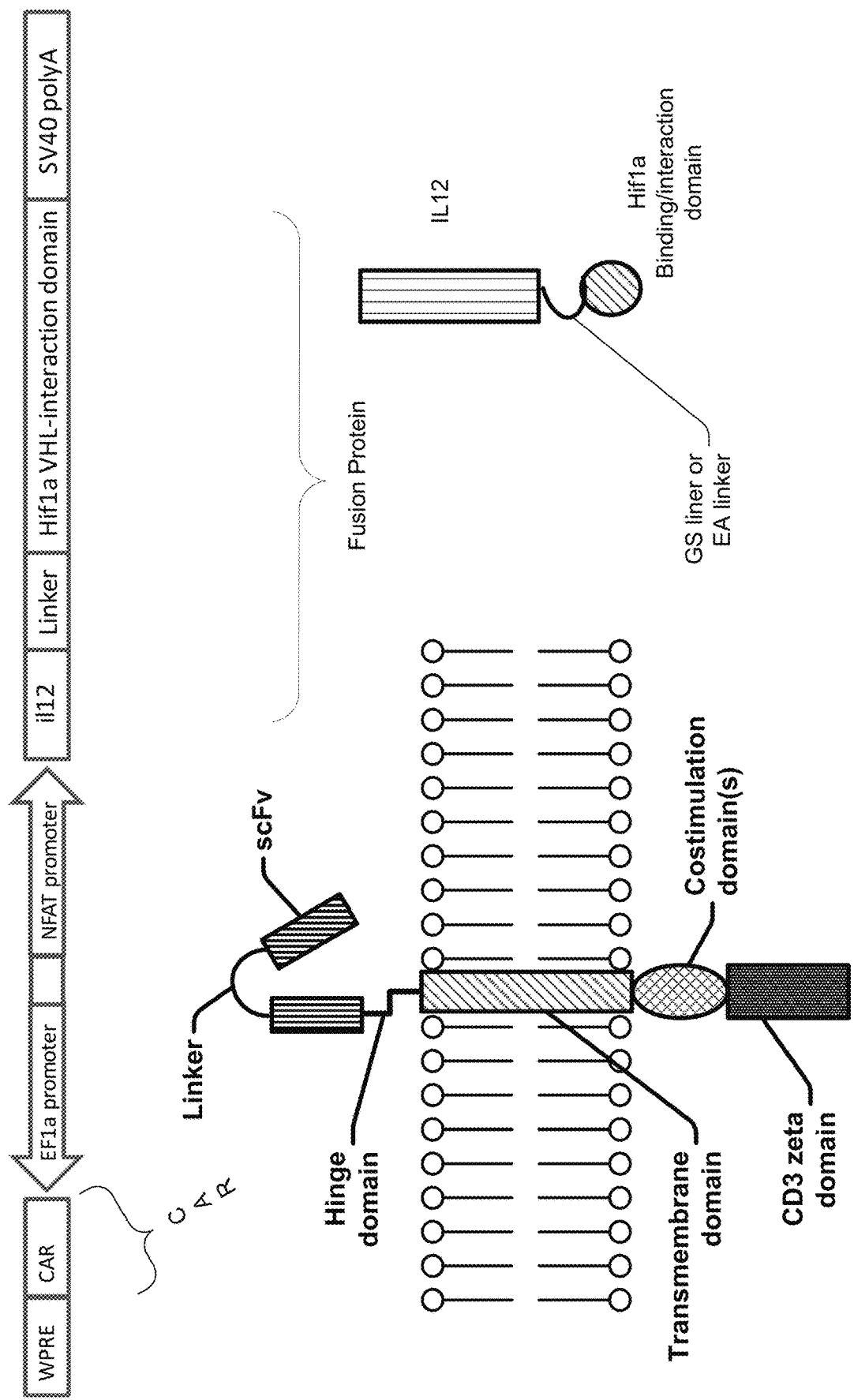
FIG. 5 is a schematic diagram of an exemplary CAR molecule and a fusion protein.
Figure 6:
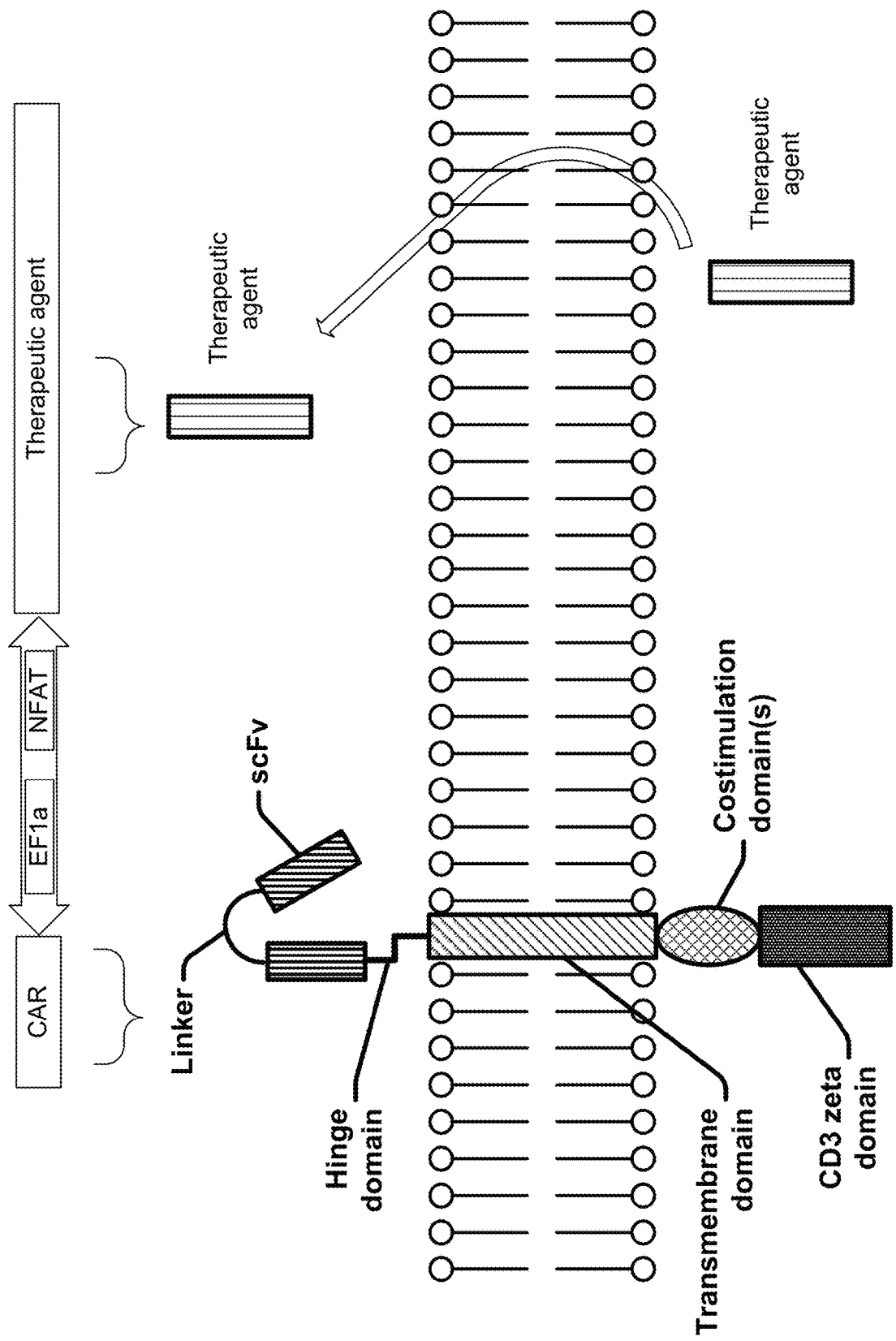
FIG. 6 is a schematic diagram of an exemplary CAR molecule and a protein expressed by a modified cell.
Figure 7:
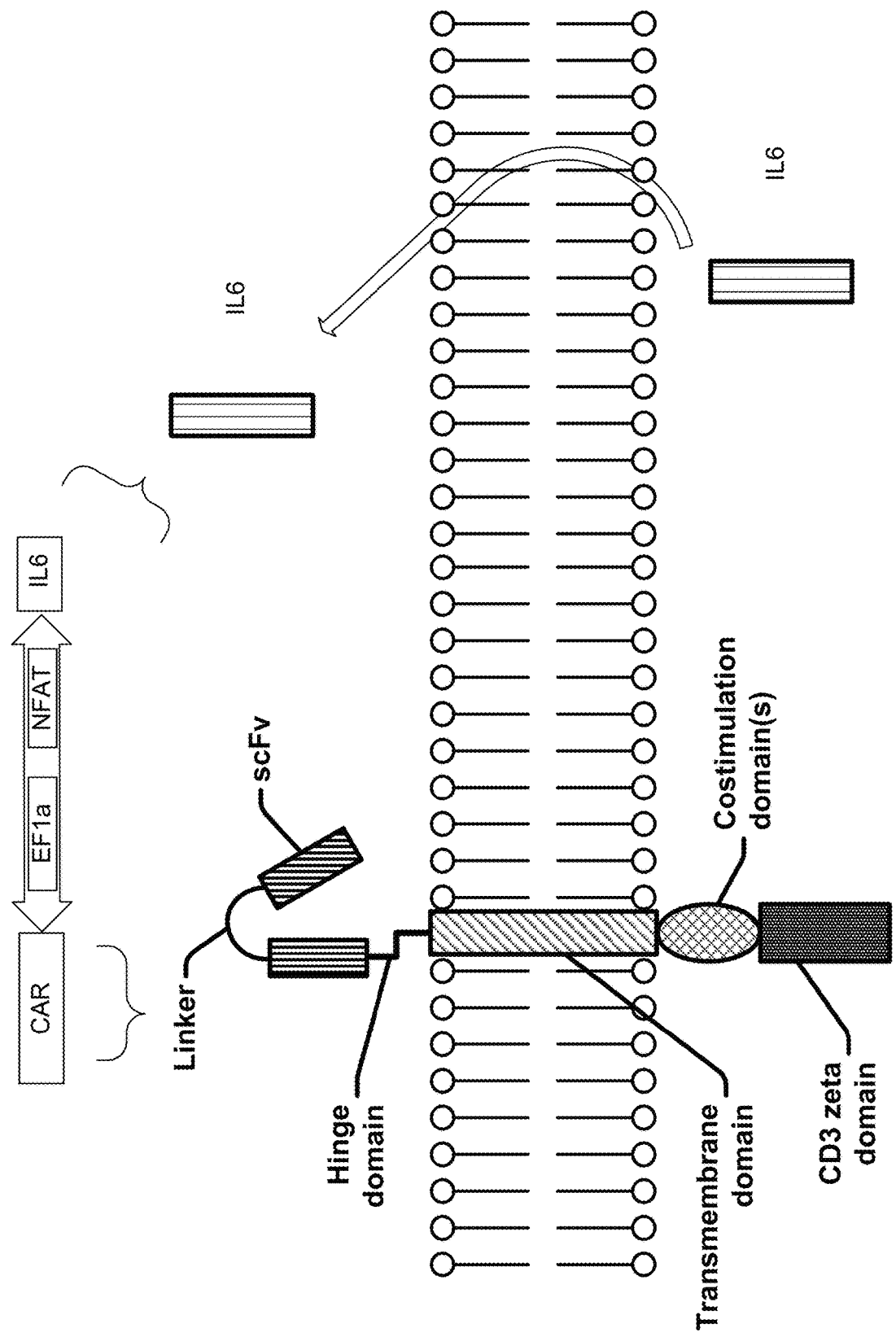
FIG. 7 is a schematic diagram of another exemplary CAR molecule and one or more proteins expressed by a modified cell.
Figure 8:
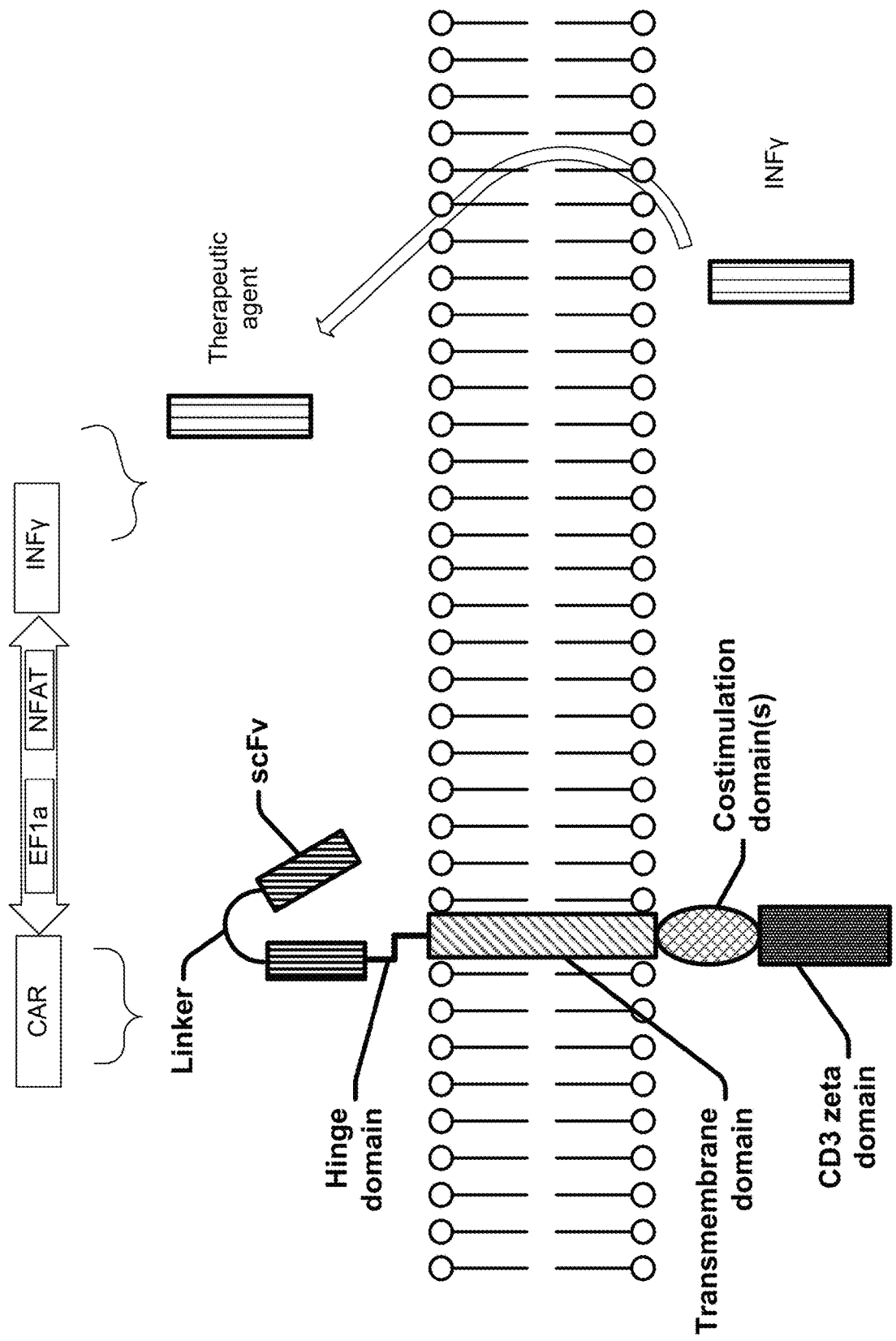
FIG. 8 is a schematic diagram of yet another exemplary CAR molecule and one or more proteins expressed by a modified cell.
Figure 9:
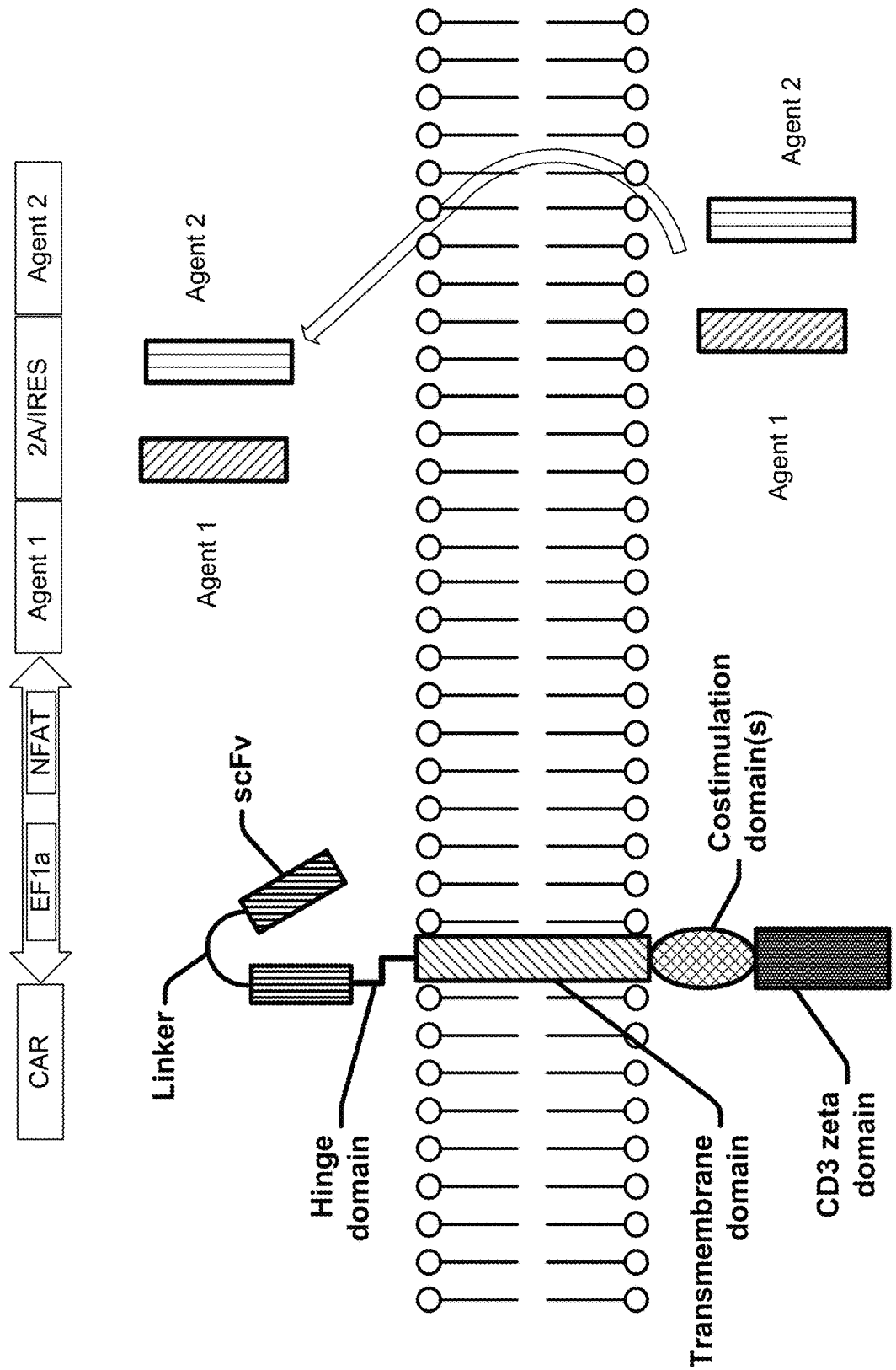
FIG. 9 is a schematic diagram of yet another exemplary CAR molecule and one or more proteins expressed by a modified cell.

161. A nucleic acid sequence encoding the fusion of any of embodiments 157-160 or comprising one or more components shown in FIG. 5.

162. A modified cell comprising the fusion protein of any of embodiments 157-160 and/or the nuclei acid sequence of embodiments 161.

163. The cell of embodiment 162, wherein the fusion protein is regulated by NFAT.

164. A pharmaceutical composition comprising a population of the modified cells of any one of embodiments 162 and 163.

165. A method of cause T cell response in a subject in need thereof and/or treating a tumor of the subject, the method comprising administering an effective amount of the composition of embodiment 164 to the subject.

166. The modified cell, pharmaceutical composition or method of any one of embodiments 162-165, wherein the modified cell is lymphocyte, leukocyte, or PBMC; or cells, NK cells, or dendritic cells.

167. The modified cell, pharmaceutical composition or method of any one of embodiments 162-166, wherein the modified cell further comprises a Chimeric antigen receptor (CAR) or a modified TCR.

168. The modified cell, pharmaceutical composition or method of embodiment 167, wherein the TCR is modified TCR.

169. The modified cell, pharmaceutical composition or method of embodiment 167, wherein the TCR is derived from spontaneously occurring tumor-specific T cells in patients.

170. The modified cell, pharmaceutical composition or method of embodiment 167, wherein the TCR binds a tumor antigen.

171. The modified cell, pharmaceutical composition or method of embodiment 170, wherein the tumor antigen comprises CEA, gp100, MART-1, p53, MAGE-A3, or NY-ESO-1, or the TCR comprises TCRγ and TORδ Chains or TCRα and TCRβ chains, or a combination thereof.

172. The modified cell, pharmaceutical composition or method of claim 167, wherein the CAR comprises an extracellular domain, a transmembrane domain, and an intracellular domain, the extracellular domain binds an antigen.

173. The modified cell, pharmaceutical composition or method of embodiment 172, wherein the intracellular domain comprises a co-stimulatory domain that comprises an intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof.

174. The modified cell, pharmaceutical composition or method of embodiment 173, wherein the antigen is Epidermal growth factor receptor (EGFR), Variant III of the epidermal growth factor receptor (EGFRvIII), Human epidermal growth factor receptor 2 (HER2), Mesothelin (MSLN), Prostate-specific membrane antigen (PSMA), Carcinoembryonic antigen (CEA), Disialoganglioside 2 (GD2), Interleukin-13Ra2 (IL13Rα2), Glypican-3 (GPC3), Carbonic anhydrase IX (CAIX), L1 cell adhesion molecule (L1-CAM), Cancer antigen 125 (CA125), Cluster of differentiation 133 (CD133), Fibroblast activation protein (FAP), Cancer/testis antigen 1B (CTAG1B), Mucin 1 (MUC1), Folate receptor-α (FR-α), CD19, FZD10, TSHR, PRLR, Muc 17, GUCY2C, CD207, CD3, CD5, B-Cell Maturation Antigen (BCMA), or CD4.

175. The modified cell, pharmaceutical composition or method of any one of embodiments 162-174, wherein the modified cell or the T cells comprise an additional CAR binding a solid tumor antigen, and the CAR binds an antigen of a white blood cell.

176. The modified cell, pharmaceutical composition or method of any one of embodiments 162-174, wherein the modified cell or the T cells comprise a dominant negative PD-1.

177. The modified cell, pharmaceutical composition or method of any one of embodiments 162-174, wherein the modified cell or the T cells comprise a modified PD-1 lacking a functional PD-1 intracellular domain.

178. The modified cell, pharmaceutical composition or method of any one of embodiments 162-177, wherein the modified cell further comprises a nucleic acid sequence encoding therapeutic agent.

179. The modified cell, pharmaceutical composition or method of any one of embodiments 178, wherein the isolated nucleic acid sequence comprises a promoter comprising a binding site for a transcription modulator that modulates the expression and/or secretion of the therapeutic agent in the cell.

180. The modified cell, pharmaceutical composition or method of embodiment 179, wherein the transcription modulator is or includes Hif1a, NFAT, FOXP3, and/or NFkB.

181. The modified cell, pharmaceutical composition or method of embodiment 180, wherein the promoter is responsive to the transcription modulator.

182. The modified cell, pharmaceutical composition or method of embodiment 180, wherein the promoter is operably linked to the nucleic acid sequence encoding the therapeutic agent such that the promoter drives expression and/or secretion of the therapeutic agent in the cell.

183. The modified cell, pharmaceutical composition or method of embodiment 180, wherein expression of the therapeutic agent is regulated by an inducible gene expression system.

184. The modified cell, pharmaceutical composition or method of embodiment 183, wherein the inducible gene expression system comprises or is a lac system, a tetracycline system, or a galactose system.

185. The modified cell, pharmaceutical composition or method of embodiment 183, wherein the inducible gene expression system comprises or is a tetracycline system.

186. The modified cell, pharmaceutical composition or method of embodiment 185, wherein the inducible gene expression system comprises or is a tetracycline on system, and an inducer is tetracycline, doxycycline, or an analog thereof.

187. The modified cell, pharmaceutical composition or method of any one of embodiments 162-186, wherein the modified cell is a T cell derived from a primary human T cell isolated from a human donor.

188. The modified cell, pharmaceutical composition or method of embodiment 187, wherein the cell has a reduced expression of endogenous TRAC gene.

189. The modified cell, pharmaceutical composition or method of any one of embodiments 162-186, wherein the modified cell is a T cell derived from a primary human T cell isolated from a subject having cancer.

190. A composition comprising a first population of cells comprising a first molecule binding a first antigen and a second population of cells comprising a second molecule binding a second antigen, wherein the second antigen is a tumor antigen and the first antigen and second antigen are different antigens, and the first population of cells and/or the second population of cells comprise a nucleic acid sequence encoding a therapeutic agent that is or comprises IL-6 or IFN-γ, or a combination thereof.

191. The composition of embodiment 190, wherein the first molecule is a first CAR, and the second molecule is a second CAR; or the first molecule is the first CAR, and the second molecule is a TCR.

192. The composition of embodiment 191, wherein the first population of cells does not comprise the second CAR, and/or the second population of cells does not comprise the first CAR.

193. The composition of embodiment 192, wherein the composition further comprises a third population of cells comprising one or more nucleic acid sequences encoding the first CAR and the second CAR.

194. The composition of embodiment 191, wherein:
the second population of cells comprises the first CAR, and the first population of cells do not comprise the second CAR; or
the first population of cells comprises the second CAR.

195. The composition of embodiment 194, wherein second population of cells does not comprise the first CAR, and the first population of cells comprise the second CAR.

196. A method of enhancing expansion of the second population of cells (cells targeting solid tumor), the method comprising administering an effective amount of the composition of one of embodiments 191-195 to a subject having a form of cancer associated with or expresses the tumor antigen.

197. A method of enhancing T cell response in a subject or treating the subject having cancer, the method comprising administering an effective amount of the composition of one of embodiments 191-195 to the subject having cancer associated with or expresses the tumor antigen.

198. A method of enhancing expansion of cells in a subject, the method comprising:
contacting cells with a first vector comprising a first nucleic acid sequence encoding the first CAR and a second vector comprising a second nucleic acid sequence encoding the second CAR to obtain the composition of one of embodiments 191-195; and
administering an effective amount of the composition to the subject having a form of cancer associated with or expresses the tumor antigen.

199. A method of enhancing T cell response in a subject or treating the subject having cancer, the method comprising:
contacting cells with a first vector comprising a first nucleic acid sequence encoding the first CAR and a second vector comprising a second nucleic acid sequence encoding the second CAR to obtain the composition of one of embodiments 191-195; and
administering an effective amount of the composition to the subject having a form of cancer associated with or expresses the tumor antigen.

200. A method of enhancing expansion of cells in a subject, the method comprising:
administering an effective amount of the first population of cells of one of embodiments 191-195; and
administering an effective amount of the second population of cells.

201. The method of one of embodiments 196-200, wherein the first vector and the second vector comprise lentiviral vectors.
202. The composition or the method of one of embodiments 190-201, wherein the first or second antigen is or comprises a surface molecule of a white blood cell (WBC), a tumor antigen, or a solid tumor antigen.
203. The composition or the method of one of embodiments 190-201, wherein the cells are modified T cells, modified NK cells, or modified dendritic cells.
204. The composition or the method of embodiment 202, wherein the WBC is a granulocyte, a monocyte, or lymphocyte.
205. The composition or the method of embodiment 204, wherein the WBC is a B cell.
206. The composition or the method of embodiment 205, wherein the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, or CD13.
207. The composition or the method of embodiment 202, wherein the cell surface molecule of the WBC is CD19, CD20, CD22, or BCMA.
208. The composition or the method of embodiment 202, wherein the cell surface molecule of the WBC is CD19.
209. The composition or the method of embodiment 202, wherein the tumor antigen is a solid tumor antigen.
210. The composition or the method of embodiment 202, wherein the solid tumor antigen is tMUC1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Rα2, Mesothelin, PSMA, ROR1, VEGFR-II, GD2, FR-α, ErbB2, EpCAM, EGFRvIII, B7-H3, or EGFR.
211. The composition or the method of embodiment 202, wherein the solid tumor antigen is or comprises tumor associated MUC1.
212. The composition or the method of one of embodiments 191-211, wherein the CAR comprises the antigen binding domain, a transmembrane domain, a co-stimulatory domain, and a CD3 zeta domain.
213. The composition or the method of embodiment 212, wherein the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or a combination thereof.
214. The composition or the method of embodiment 213, wherein:
a co-stimulatory domain of the second CAR comprises or is an intracellular domain of 4-1BB, and a binding domain of the second CAR binds TSHR; and/or
a binding domain of the first CAR binds CD19 and a co-stimulatory domain of the second CAR comprises or is an intracellular domain of CD28.
215. The composition or the method of any one of embodiments 191-214, wherein the first population of cells and/or the second population of cells further comprise a dominant negative form of PD-1.
216. The composition or the method of embodiment 215, wherein the first population of cells comprise a vector encoding the first CAR and the dominant negative form of PD-1.
217. The composition or the method of one of embodiments 191-216, wherein the first CAR comprises a scFv binding TSHR, an intracellular domain of 4-1BB or CD28, CD3 zeta domain, and the second CAR comprises a scFv binding CD19, an intracellular domain of 4-1BB or CD28, CD3 zeta domain.
218. The composition or the method of one of embodiments 191-217, wherein the first CAR comprises SEQ ID NO: 5, and the second CAR comprise the SEQ ID NO: 70.
219. The composition or the method of one of embodiments 191-218, wherein the second population of cells comprises a lentiviral vector encoding the first CAR and a therapeutic agent and the first population of cells comprises a lentiviral vector encoding the second CAR and a dominant negative form of PD-1.
220. The composition or the method of one of embodiments 191-219, wherein the first population of cells comprise the first CAR and a therapeutic agent and the second population of cells comprise the second CAR and a dominant negative form of PD-1.
221. The composition or the method of one of embodiments 219 and 220, wherein the therapeutic agent comprises or is a cytokine.
222. The composition or the method of embodiment 221, wherein the cytokine is IL6 and/or INFγ.
223. A method comprising:
administering an effective amount of a first population of T cells comprising a CAR comprising a scFv binding CD19, an intracellular domain of 4-1BB or CD28, CD3 zeta domain to the patient, thereby enhancing expansion of the first population of T cells in the patient; and
administering an effective amount of a second population of T cells comprising a CAR comprising a scFv binding TSHR to a patient having cancer, an intracellular domain of 4-1BB or CD28, CD3 zeta domain.
224. The method of embodiment 223, wherein first population of cells further comprise an additional CAR comprising the scFv binding tMUC1, the intracellular domain of 4-1BB or CD28, and the CD3 zeta domain.
225. The method of embodiment 223, wherein the second population of cells does not comprise the scFv binding CD19.
226. The method of embodiment 223, wherein the first population of cells does not comprise the scFv binding TSHR.
227. The composition of embodiment 190, wherein the first molecule is a modified TCR.
228. The composition of embodiment 227, wherein the TCR is derived from spontaneously occurring tumor-specific T cells in patients.
229. The composition of embodiment 227, wherein the TCR binds a tumor antigen.
230. The composition of embodiment 227, wherein the tumor antigen comprises CEA, gp100, MART-1, p53, MAGE-A3, or NY-ESO-1, or the TCR comprises TCRγ and TORδ Chains or TCRα and TCRβ chains, or a combination thereof.
231. The modified cell, pharmaceutical composition or method of one of embodiments 190-230, wherein the modified cell is a T cell derived from a primary human T cell isolated from a human donor.
232. The modified cell, pharmaceutical composition or method of embodiment 231, wherein the cell has a reduced expression of endogenous TRAC gene.
233. The modified cell, pharmaceutical composition or method of one of embodiments 190-230, wherein the modified cell is a T cell derived from a primary human T cell isolated from a subject having cancer.

234. The isolated nucleic acid sequence, the population of CAR cells, the pharmaceutical composition, or the method of one of embodiments 190-233, wherein the nucleic acid sequence comprises a first nucleic acid sequence encoding IL6 and a second nucleic acid sequence encoding IFN-γ, and the first nucleic acid sequence and the second nucleic acid sequence are connected by an IRES element or a third nucleic acid sequence encoding a 2A peptide.

235. The isolated nucleic acid sequence, the population of CAR cells, the pharmaceutical composition, or the method of one of embodiments 190-234, wherein the nucleic acid sequence is or comprises the nucleic acid sequence encoding one or more amino acid sequences of SEQ ID NOs: 287 and/or 328, or a combination thereof.

236. The isolated nucleic acid sequence, the population of CAR cells, the pharmaceutical composition, or the method of one of embodiments 190-235, wherein expression of the nucleic acid sequence is regulated by a conditional expression system such that the therapeutic agent is expressed in response to binding of a target antigen.

48 The isolated nucleic acid sequence, the population of CAR cells, the pharmaceutical composition, or the method of one of embodiments 1-47, wherein expression of the additional nucleic acid sequence is regulated by SynNotch polypeptide.

237. The isolated nucleic acid sequence, the population of CAR cells, the pharmaceutical composition, modified cell, or the method of one of embodiments 190-48, wherein T cell response is enhanced as compared to the administration of T cells that do not express or secrete the therapeutic agent, or the T cell response is enhanced as compared to the administration of CAR T cells without the administration of therapeutic agent.

238. The isolated nucleic acid sequence, the population of CAR cells, the pharmaceutical composition, modified cell, or the method of one of embodiments 190-49, wherein expression and/or secretion of the therapeutic agent is regulated by an inducible expression system and/or the modified cell comprises a nucleic acid sequence encoding an inducible suicide system.

239. The isolated nucleic acid sequence, the population of CAR cells, the pharmaceutical composition, modified cell, or the method of embodiments 190-49, wherein a range of concentration values of IL6 is 60 to 5000 pg/ml, 200-5000 pg/ml, or 2000-5000 pg/ml in the blood of the subject.

240. The isolated nucleic acid sequence, the population of CAR cells, the pharmaceutical composition, modified cell, or the method of one of embodiments 190-49, wherein a range of concentration values IFN-γ is 20 to 5000 pg/ml, 200 to 5000 pg/ml, or 500 to 5000 pg/ml in the blood of the subject.

241. The isolated nucleic acid sequence, the population of CAR cells, the pharmaceutical composition, modified cell, or the method of one of embodiments 190-235, wherein the modified cell comprises a nucleic acid sequence comprising a binding site for a transcription modulator that modulates the expression and/or secretion of the therapeutic agent in the cell.

242. The isolated nucleic acid sequence, the population of CAR cells, the pharmaceutical composition, modified cell, or the method of embodiment 241, wherein the transcription modulator is or includes Hif1a, NFAT, FOXP3, and/or NFkB.

55 The isolated nucleic acid sequence, the population of CAR cells, the pharmaceutical composition, modified cell, or the method of embodiment 53, wherein the promoter is responsive to the transcription modulator.

243. The isolated nucleic acid sequence, the population of CAR cells, the pharmaceutical composition, modified cell, or the method of embodiment 241, wherein the promoter is operably linked to the nucleic acid sequence encoding the therapeutic agent such that the promoter drives 57 and/or secretion of the therapeutic agent in the cell.

244. The isolated nucleic acid sequence, the population of CAR cells, the pharmaceutical composition, modified cell, or the method of one of embodiments 241-56, wherein the promoter comprises at least one of SEQ ID Nos: 332, 333, 341, 469, or 342.

245. The isolated nucleic acid sequence, the population of CAR cells, the pharmaceutical composition, modified cell, or the method of one of embodiments 190-57, wherein the first and second population of cells comprises TSHR-CAR (scFv of the CAR: SEQ ID NO: 8): and hCD19-CAR-NATF-IL6-2A-IFNγ (scFv of CD19 CAR: SEQ ID 5, aa of NATF: SEQ ID: 469, aa of IL6: SEQ ID NO: 287, 2A is SEQ ID NO: 326, and aa of IFN-γ: SEQ ID NO: 327). SEQ ID NO: 287, 2A is SEQ ID NO: 327, and aa of IFN-γ: SEQ ID NO: 328).

246. An isolated nucleic acid sequence comprising a nucleic acid sequence and an additional nucleic acid sequence, the nucleic acid sequence encoding a chimeric antigen receptor (CAR), the additional nucleic acid sequence encoding a therapeutic agent that is or comprises IL-6 or IFN-γ, or a combination thereof.

247. A population of CAR cells comprising the nucleic acid sequence and the additional nucleic acid sequence of embodiments 246, wherein the CAR cells comprise lymphocyte, leukocyte, or PBMC.

248. The population of CAR cells of embodiment 247, wherein the CAR and the therapeutic agent are produced in the form of a polyprotein, which is cleaved to generate separate CAR and therapeutic agent molecules.

249. The population of CAR cells of one of embodiments 247-248, wherein the polyprotein comprises a cleavable moiety between the CAR and the therapeutic agent, the cleavable moiety comprises a 2A peptide, the 2A peptide comprises P2A or T2A, and/or the CAR and the therapeutic agent are each constitutively expressed.

250. The population of CAR cells of one of embodiments 247-249, wherein the CAR cells comprise:
a third nucleic acid sequence encoding an additional CAR binding to an antigen that is different from an antigen that the CAR binds, or
the additional CAR binding a solid tumor antigen, and the CAR binds an antigen of a white blood cell.

251. A pharmaceutical composition comprising the population of the CAR cells of one of embodiments 247-250.

252. A method of causing T cell response in a subject in need thereof and/or treating a tumor of the subject, the method comprising administering an effective amount of the composition of embodiment 251 to the subject.

253. The isolated nucleic acid sequence, the population of CAR cells, the pharmaceutical composition, or the method of one of embodiments 246-252, wherein the additional nucleic acid sequence comprises a first nucleic acid sequence encoding IL6 and a second nucleic acid sequence encoding IFN-γ, and the first nucleic acid sequence and the second nucleic acid sequence are connected by an IRES element or a third nucleic acid sequence encoding a 2A peptide.

254. The isolated nucleic acid sequence, the population of CAR cells, the pharmaceutical composition, or the method of one of embodiments 246-253, wherein the additional nucleic acid sequence is or comprises the nucleic acid sequence of SEQ ID NOs: 287 or 328, or a combination thereof.

255. The isolated nucleic acid sequence, the population of CAR cells, the pharmaceutical composition, or the method of one of embodiments 246-254, wherein expression of the additional nucleic acid sequence is regulated by a conditional expression system such that the therapeutic agent is expressed in response to binding of a target antigen.

11 The isolated nucleic acid sequence, the population of CAR cells, the pharmaceutical composition, or the method of one of embodiments 1-10, wherein expression of the additional nucleic acid sequence is regulated by SynNotch polypeptide.

256. A modified cell comprises one or more CARs, wherein the cell is engineered to express and secrete a therapeutic agent that is or comprises IL-6 or IFN-γ, or a combination thereof.

257. A method of causing or enhancing T cell response, treating cancer, or enhancing cancer treatment, the method comprising: administrating an effective amount of the composition of T cells comprising one or more CARs, wherein the cell is engineered to express and secrete a therapeutic agent that is or comprises IL-6 or IFN-γ, or a combination thereof.

258. A method of causing or enhancing T cell response, treating cancer, or enhancing cancer treatment, the method comprising:
administering an effective amount of the composition of a population of T cells comprising a CAR; and
administering an effective amount of a therapeutic agent that is or comprises IL-6 or IFN-γ, or a combination thereof.

259. The modified cell or the method of one of embodiments 252, 257, and 258, wherein T cell response is enhanced as compared to the administration of T cells that do not express or secrete the therapeutic agent, or the T cell response is enhanced as compared to the administration of CAR T cells without the administration of therapeutic agent.

260. The modified cell or the method of one of embodiments 256-259, wherein expression and/or secretion of the therapeutic agent is regulated by an inducible expression system and/or the modified cell comprises a nucleic acid sequence encoding an inducible suicide system.

261. The modified cell or the method of one of embodiments 256-259, wherein a range of concentration values of IL6 is 60 to 5000 pg/ml, 200-5000 pg/ml, or 2000-5000 pg/ml in the blood of the subject.

262. The modified cell or the method of one of embodiments 256-259, wherein a range of concentration values IFN-γ is 20 to 5000 pg/ml, 200 to 5000 pg/ml, or 500 to 5000 pg/ml in the blood of the subject.

263. The modified cell or the method of one of embodiments 256-262, wherein the administering the effective amount of the therapeutic agent comprises intravenous delivery of an amount of human IL-6 in the range of about 0.5-50 ug per kilogram of body weight.

264. The modified cell or the method of one of embodiments 256-263, wherein the modified cell or the T cells comprise an additional CAR binding a solid tumor antigen, and the CAR binds an antigen of a white blood cell.

265. The modified cell or the method of embodiment 264, wherein the solid tumor antigen is tMUC 1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Rα2, Mesothelin, PSMA, ROR1, VEGFR-II, GD2, FR-α, ErbB2, EpCAM, EGFRvIII, PSCA, or EGFR, and the B cell antigen is CD19, CD20, CD22, or BCMA.

266. The modified cell or the method of one of embodiments 256-265, wherein the modified cell or the T cells comprise a dominant negative PD-1.

22. The modified cell or the method of one of embodiments 12-21, wherein the modified cell or the T cells comprise a modified PD-1 lacking a functional PD-1 intracellular domain.

268. The isolated nucleic acid sequence, the population of CAR cells, the pharmaceutical composition, modified cell, or the method of one of embodiments 246-23, wherein the CAR comprises an extracellular domain, a transmembrane domain, and an intracellular domain, the extracellular domain binds an antigen.

269. The isolated nucleic acid sequence, the population of CAR cells, the pharmaceutical composition, modified cell, or the method of one of embodiments 246-23, wherein the intracellular domain comprises a co-stimulatory domain that comprises an intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and one combination thereof.

270. The isolated nucleic acid sequence, the population of CAR cells, the pharmaceutical composition, modified cell, or the method of one of embodiments 246-24, wherein the antigen is Epidermal growth factor receptor (EGFR), Variant III of the epidermal growth factor receptor (EGFRvIII), Human epidermal growth factor receptor 2 (HER2), Mesothelin (MSLN), Prostate-specific membrane antigen (PSMA), Carcinoembryonic antigen (CEA), Disialoganglioside 2 (GD2), Interleukin-13Ra2 (IL13Rα2), Glypican-3 (GPC3), Carbonic anhydrase IX (CAIX), L1 cell adhesion molecule (L1-CAM), Cancer antigen 125 (CA125), Cluster of differentiation 133 (CD133), Fibroblast activation protein (FAP), Cancer/testis antigen 1B (CTAG1B), Mucin 1 (MUC1), Folate receptor-α (FR-α), CD19, FZD10, TSHR, PRLR, Muc 17, GUCY2C, CD207, CD3, CD5, B-Cell Maturation Antigen (BCMA), or CD4.

271. The isolated nucleic acid sequence, the population of CAR cells, the pharmaceutical composition, modified cell, or the method of one of embodiments 246-25, wherein the therapeutic agent is present in the modified cell in a recombinant DNA construct, in an mRNA, or in a viral vector.

272. The isolated nucleic acid sequence, the population of CAR cells, the pharmaceutical composition, modified cell, or the method of one of embodiments 246-26, wherein the modified cell comprises a therapeutic agent mRNA encoding the therapeutic agent, and the mRNA is not integrated into the genome of the modified cell.

273. The isolated nucleic acid sequence, the population of CAR cells, the pharmaceutical composition, modified cell, or the method of one of embodiments 246-27, wherein the modified cell comprises a nucleic acid sequence comprising a promoter comprising a binding site for a transcription modulator that modulates the expression and/or secretion of the therapeutic agent in the cell.

274. The isolated nucleic acid sequence, the population of CAR cells, the pharmaceutical composition, modified cell, or the method of embodiment 273, wherein the transcription modulator is or includes Hif1a, NFAT, FOXP3, and/or NFkB.

275. The isolated nucleic acid sequence, the population of CAR cells, the pharmaceutical composition, modified cell, or the method of embodiment 273, wherein the promoter is responsive to the transcription modulator.

276. The isolated nucleic acid sequence, the population of CAR cells, the pharmaceutical composition, modified cell, or the method of embodiment 273, wherein the promoter is operably linked to the nucleic acid sequence encoding the therapeutic agent such that the promoter drives expression and/or secretion of the therapeutic agent in the cell.

277. The isolated nucleic acid sequence, the population of CAR cells, the pharmaceutical composition, modified cell, or the method of one of embodiments 273-276, wherein the promoter comprises at least one of SEQ ID Nos: 323-325.

278. A method of using any one of the preceding embodiments (1-277) in autologous T cell therapy, allogenic T cell therapy, TCR T cell therapy, or NK cell therapy.

279. The CAR described in any one of the preceding embodiments (1-278), wherein the CAR comprises one or more of the complementarity determining regions (CDRs) that binds an antigen of interest.

EXAMPLES

In Vivo Expansion and Treatment of Cancer

These clinical studies were designed to assess the safety and efficacy of infusing autologous T cells modified to express TSHR specific CAR/4-1BB/CD3-ζ into patients. On the first arm of the studies, patients received TSHR CAR T cells only. On the second arm, patients received CAR T cells directed to CD19 and TSHR. Autologous T cells modified to express TSHR specific CAR/4-1BB/CD3-ζ (TSHR CAR) and CD19 specific CAR/4-1BB/CD3-ζ (CD19 CAR) were infused into a patient. The modified T cell included T cells expressing TSHR CAR (single CAR), CD19 CAR (single CAR), and TSHR CAR&CD19 CAR, respectively (Double CAR). T cells of the patients were obtained, modified, and infused to the patients. T cell responses of patients from the first and second arms were measured and compared using the following protocols, which were approved by the hospitals where the trials were conducted. All patients were provided with written informed consent (SD: stable disease; PD: progressive disease; PR: partial remission; CR: complete remission; NR, no response).

TABLE 5

| Cancer | Patient ID | Target Marker | Infusion CART/kg | Vectors mixed with T cells | Safety or Adverse reaction (AR) | Efficacy |
| --- | --- | --- | --- | --- | --- | --- |
| Thyroid cancer | 001 | TSHR | $1.1 \times 10^6$ | Vectors encoding TSHR-CAR & vectors encoding CD19-CAR | No apparent AR | PR (day 29) CR (day 64) |
| Thyroid cancer | 002 | TSHR | $1.1 \times 10^6$ | Vector encoding TSHR-CAR | No apparent AR | NR |

Manufacturing of CAR T Cells

PBMCs were obtained from patients. Various lentiviral vectors were generated and then transfected to the T cells, which were further cultured for several days before the co-cultivation assay. More information may be found in Table 6 below. Techniques related to cell cultures and cytotoxic T-lymphocyte assay may be found in "Control of large, established tumor xenografts with genetically retargeted human T cells containing CD28 and CD137 domains," PNAS, Mar. 3, 2009, vol. 106 no. 9, 3360-3365, which is incorporated herein by reference in its entirety.

TABLE 6

Figure 10:
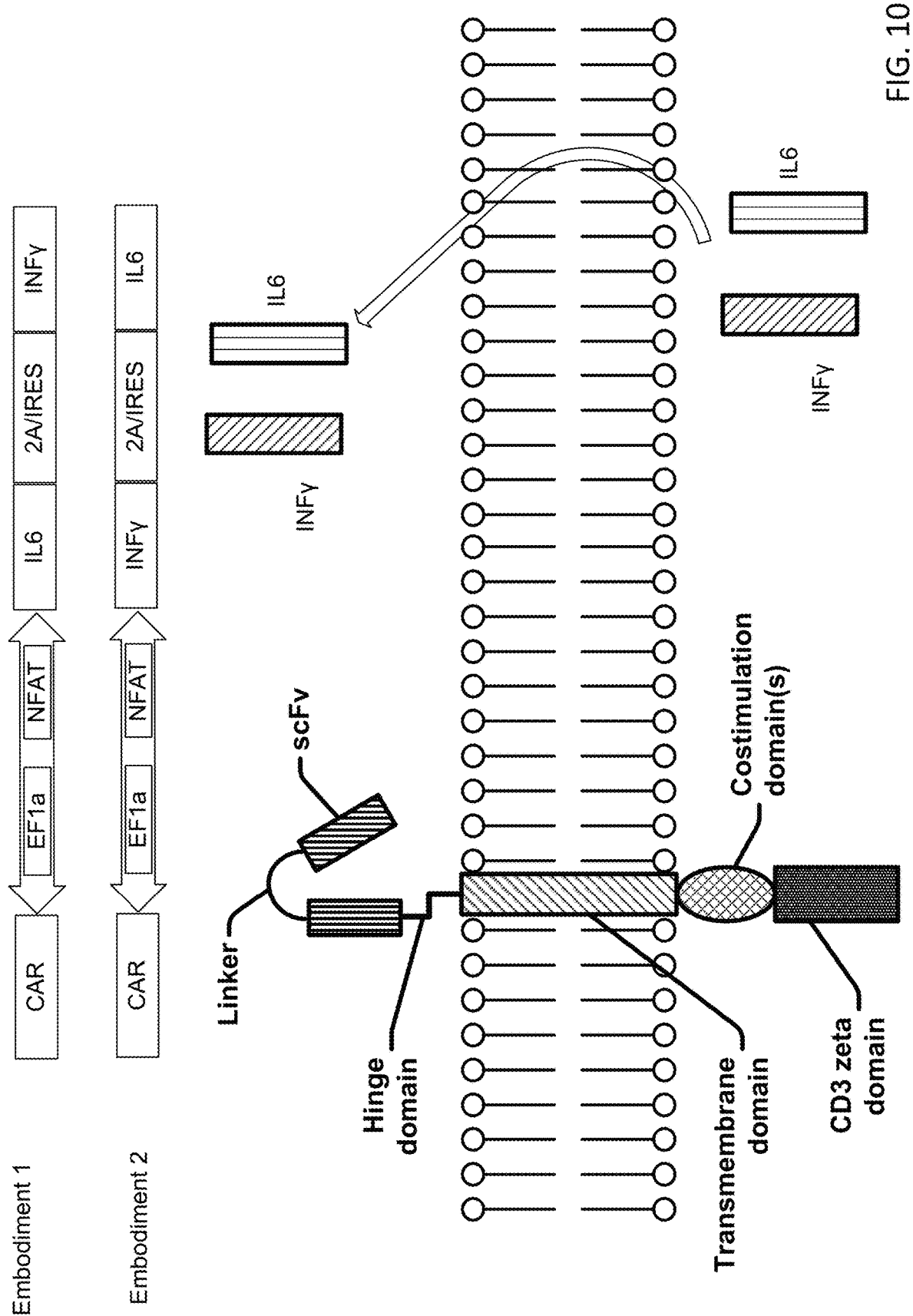
FIG. 10 is a schematic diagram of yet another exemplary CAR molecule and one or more proteins expressed by a modified cell.

| P's ID | Vectors and MOI | Infusion Methods | Pre-treatment |
| --- | --- | --- | --- |
| 001 | TSHR-CAR (CAR: SEQ ID NO: 279; scFv of the CAR: SEQ ID NO: 8): 19:1 hCD19-CAR-NATF-IL6-2A-IFNγ (scFv of CD19 CAR: SEQ ID 5, 6xNFAT: SEQ ID: 469, aa of IL6: SEQ ID NO: 287, 2A is SEQ ID NO: 326, and aa of IFN-γ: SEQ ID NO: 327 (See Embodiment 1 of FIG. 10)): 5:1 | Fresh cells | FC regimen at −5 to −3 days (cyclophosphamide 500 mg/m2, fludarabine 30 mg/m2) |
| 002 | TSHR-CAR (CAR: SEQ ID NO: 279; scFv of the CAR: SEQ ID NO: 8): 19:1 | Fresh cells | FC regimen at −5 to −3 days (cyclophosphamide 500 mg/m2, fludarabine 30 mg/m2) |

PBMCs were cultured using TEXMACS culture containing IL-2. CD4, and CD8 magnetic beads were used to sort and select T cells in the PBMCs. The appropriate starting culture amount was selected and TransAct activator was used to activate T cells. MACS® GMP T Cell TransAct™ includes a colloidal polymeric nanomatrix covalently attached to humanized recombinant agonists against human CD3 and CD28. Due to the nanomatrix MACS GMP T Cell TransAct can be sterile filtered and excess reagent can be removed by centrifugation and following conventional supernatant replacement or simply by medium wash. This reagent is suitable for use in automated culture systems, such as the CliniMACS Prodigy® Instrument. The number of corresponding carriers and the volume of the carrier were calculated according to the required carrier MOI (See Table 6). Various assays were performed to confirm the efficacy of these CAR T cells (e.g., a binding assay using flow cytometry and a killing assay using culturing assay with cells expressing TSHR/CD19), and quality assurance procedures were followed to ensure the safety of the administration of the CAR T cells to the patient.

Figure 18:
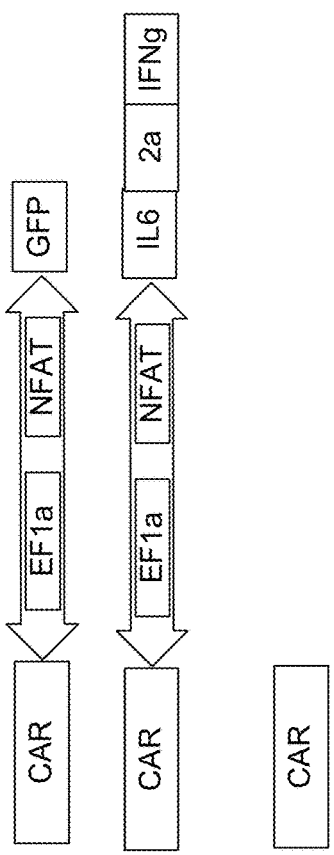
FIG. 18 includes various constructs of CAR and therapeutic agents that may be expressed by T cells.

FIG. 18 shows copy numbers of T cells expressing various proteins. Day 1, T cells from healthy donor were sorted and activated using CD3/CD28 beads. Day 2, $10^5$ cells were transfected with vectors 1230 (MOI 10:1), 6205 (hCD19CAR-GFP) (MOI 60:1), and 6221 (hCD19CAR-6× NFAT-IL6-2a-IFNg) (MOI 60:1), respectively. On Day 3, cell media were changed. On Day 4, cell numbers were counted. On Days 5, 6, and 8, assays for measuring culturing factors, CAR copy number, phenotype and expression were conducted. Day 8, toxicity assays were performed, and culturing factors were detected. The copy numbers are provided in Table 7 below. In this and the following examples, sequences for NFAT is SEQ ID NO 469; for TSHR-CAR is SEQ ID NO: 279; for scFv of TSHR CAR is SEQ ID NO: 8; for scFv of CD19 CAR is SEQ ID 5; for IL6 is SEQ ID NO: 287; for 2A is SEQ ID NO: 327; and for IFN-γ is SEQ ID NO: 328. Sequences of other components may be found in Table 2.

Table 7 shows copy numbers of CAR per CAR T cell.

| Type of T cells | 6205 | 6221 | 1230 |
|---|---|---|---|
| Day 8/per CAR-T | 1.02728 | 0.66634 | 1.3325 |

Figure 19:
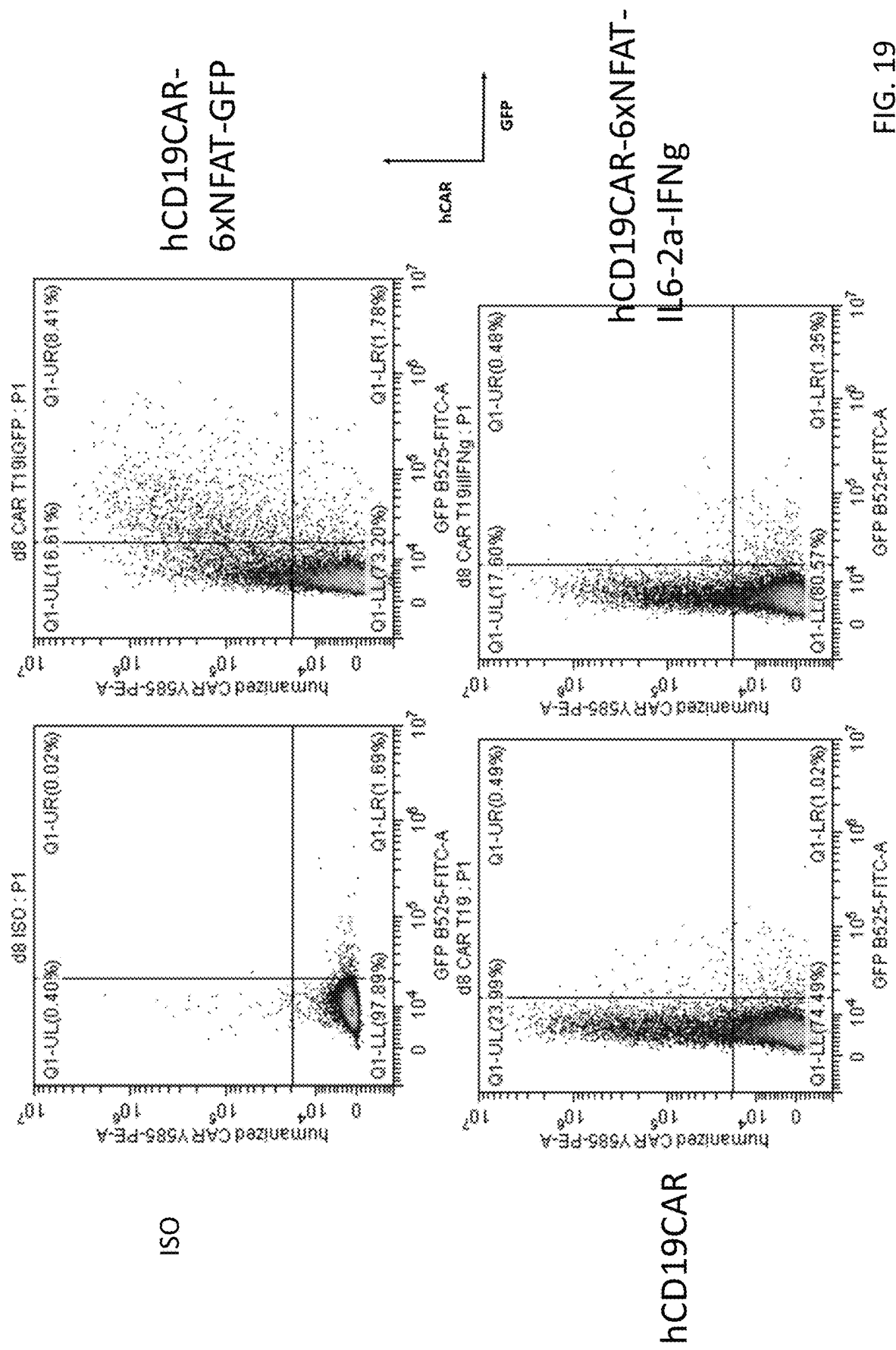
FIG. 19 shows flow cytometry assay results of T cells expressing various proteins shown in FIG. 18.

FIG. 19 shows flow cytometry assay results of T cells expressing various proteins shown in FIG. 18. Day 0, peripheral blood of healthy volunteers was taken; CD3+ T cells were sorted; and CD3/CD28 Dynabeads were added in a 1:1 ratio. Day 2, T cells were transfected using lentivirus including various following vectors. CD19CAR was infected according to the infection ratio of MOI=10:1; hCD19CAR, hCD19CAR-6×NFAT-GFP, hCD19CAR-6× NFAT-GFP, hCD19CAR-6×NFAT-IL6-2a-IFNg cells were infected according to the infection ratio of MOI=60:1. Day 3, the media were changed, the lentivirus were removed, and the cells were resuspended in fresh medium. Day 7, flow cytometry assays were used to detect CAR expression. CD19CAR is a humanized antibody and is therefore detected with a human CAR antibody. As shown in FIG. 19, CD19CAR expression was 23.99%; hCD19CAR-6×NFAT-GFP CAR expression was 25%; and hCD19CAR-6×NFAT-IL6-2a-IFNg CAR expression was 17.6%. Flow cytometry assay was performed using human CAR antibody to detect the expression intensity and expression level of CAR.

Figure 20:
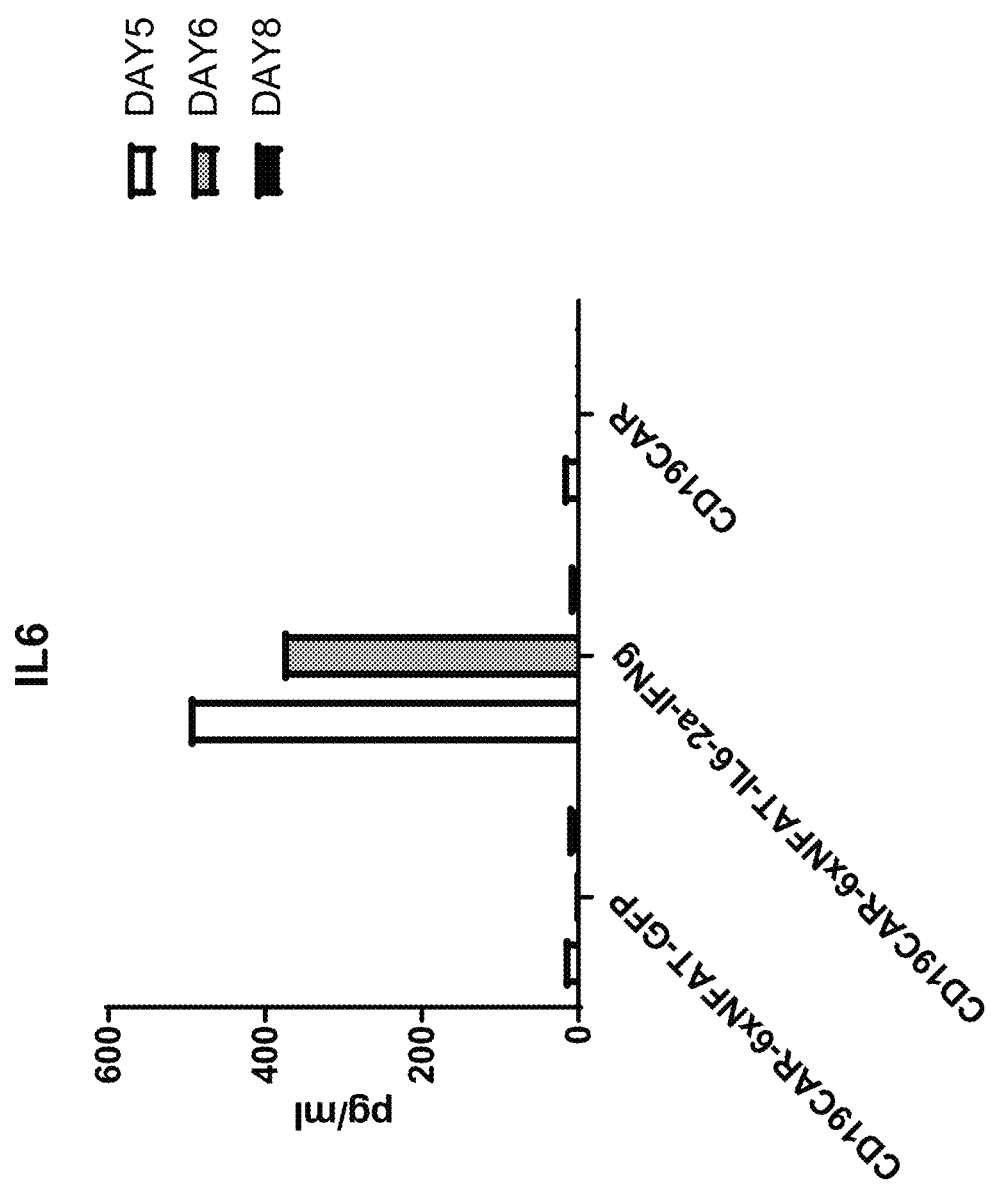
FIG. 20 shows IL6 release in response to CD3/CD28 Dynabeads activation.

FIG. 20 shows IL6 release in response to CD3/CD28 Dynabeads activation. Day 0, peripheral blood of healthy volunteers was taken, CD3+ T cells were sorted, and CD3/CD28 Dynabeads were added at a 1:1 ratio. Day 2, T cells were transfected using lentivirus including various following vectors. CD19CAR was infected according to the infection ratio of MOI=10:1; hCD19CAR, hCD19CAR-6×NFAT-GFP, hCD19CAR-6×NFAT-GFP, hCD19CAR-6×NFAT-IL6-2a-IFNg cells were infected according to the infection ratio of MOI=60:1. Day 3, the media were changed, and the lentiviruses were removed, and the cells were resuspended in fresh medium. DAY 5, 6, and 8, the cell supernatant in 200 ul culture was used to detect the release of IL6. As shown in FIG. 20, on Day 5, 6, and 8, the cell supernatant of 200 ul was taken from the media and the release of IL6 factor was detected. The amount of IL6 released per $10^4$ of CD19CAR and CD19CAR-6×NFAT-GFP was 0-10 pg/ml on Day 5, 6, and 8. $10^4$ CD19CAR-6×NFAT-IL6-2A-IFNg had IL6 release of 498 pg/ml and 378 pg/ml on Day 5 and 6, and the released amount of IL6 on Day 8 was 9.8 pg/ml. On Days 5 and 6, cells were cultured with CD3/CD28 Dynabeads such that the cells were activated, and NFAT element was activated and the transcription of IL6 was enabled, causing IL6 to be released. However, on Day 8, the effect of Dynabeads stimulation was dropped to a lower level, and the cells were not activated. Therefore, the NFAT element was turned off and the transcription of IL6 was disabled. Thus, IL6 was not released. When T cells are stimulated by CD3/28 Dynabeads, the cells are activated for a short period of time. The NFAT element induces transcriptional translation of the gene in response to the activation, and the corresponding genes are expressed. When the cells are at rest or at a lower level of activation, the NFAT element does not initiate transcriptional translation of the gene of interest. Therefore, whether the NFAT element is active or not and whether the induced gene is expressed can be judged by the expression of the target gene in the activated and inactivated state of the CART cell.

Figure 21:
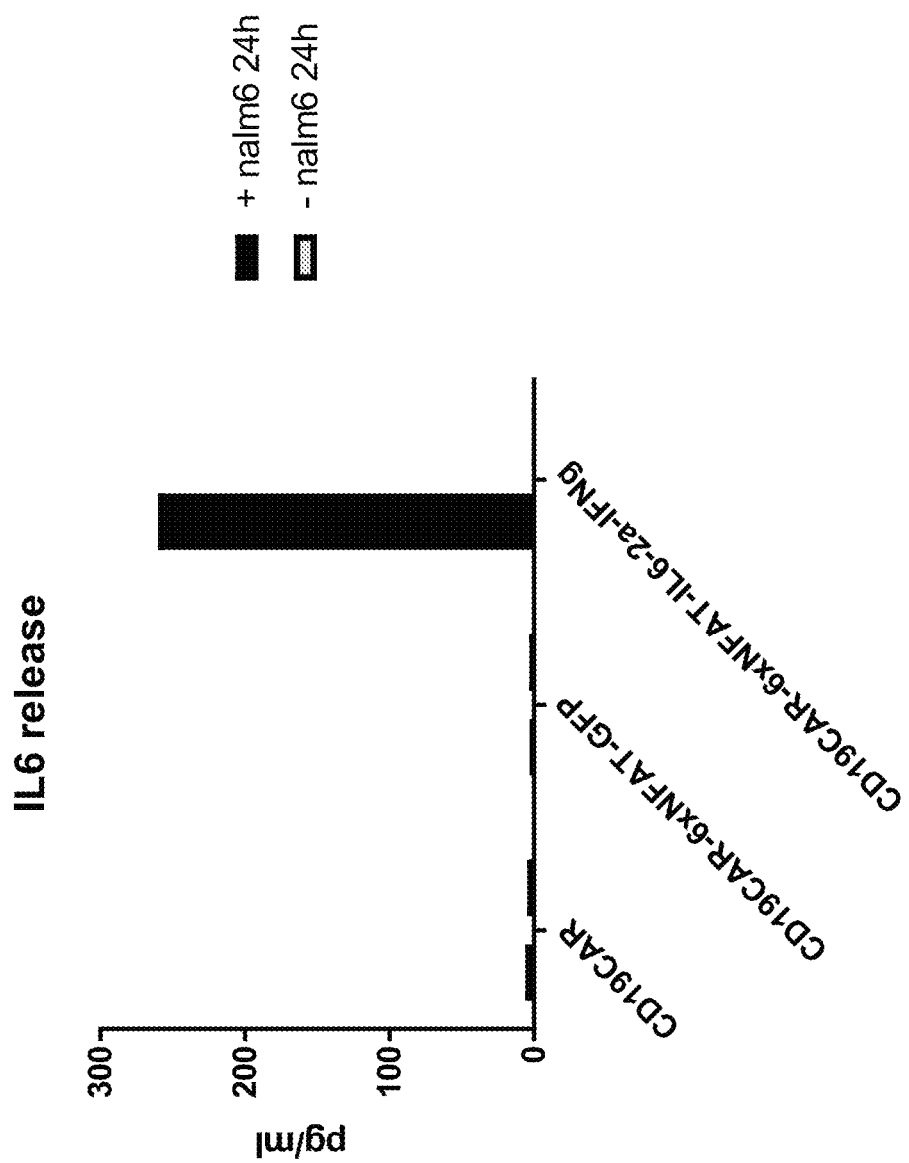
FIG. 21 shows IL6 release in response to co-culturing with Nalm6 cells.

FIG. 21 shows IL6 release in response to co-culturing with Nalm6 cells (See Table below). The cells were cultured to Day 8 and then were leveled with NT cells to differentiate the CAR ratio of CD19CAR T cells and CD19CAR-6× NFAT-GFP to cells of CD19CAR-6×NFAT-IL6-2a-IFNg. $10^4$ CAR+ cells were co-cultured with $10^4$ Nalm-6 cells or cultured separately. After 24H, the supernatant was collected and the amount of IL6 released was measured. The cells were co-cultured with Nalm6 cells and were in an activated state. Thus, the NFAT element initiated transcription of IL6 in an activated state, allowing IL6 to be released. When the CAR T cells are co-cultured with the target cells, since the CAR T cells recognize the membrane proteins on the surface of the tumor cells, the cells are activated. The NFAT element initiates transcriptional translation of the gene in response to activation. The corresponding gene is expressed. When the cell is at rest or the activation level is low, the NFAT element does not initiate transcriptional translation of the gene of interest. Therefore, whether the NFAT element is active or not and whether the induced gene is expressed can be determined by the expression of the target gene in the activated and inactivated state of the CAR T cell.

TABLE 8

| CAR T cells $10^4$ | CD19CAR-T | CD19CAR-6×NFAT-GFP | CD19CAR-6×NFAT-IL6-2a-IFNg |
|---|---|---|---|
| Co-cultured cells (25 hours) $10^4$ | Nalm6 | Nalm6 | Nalm6 |
| IL6 released: CAR T cells co-cultured with Nalm6 | 0-10 pg/ml | 0-10 pg/ml | 260 pg/ml |
| IL6 released: CAR T cells cultured alone | 0-10 pg/ml | 0-10 pg/ml | 0-10 pg/ml |

Figure 22:
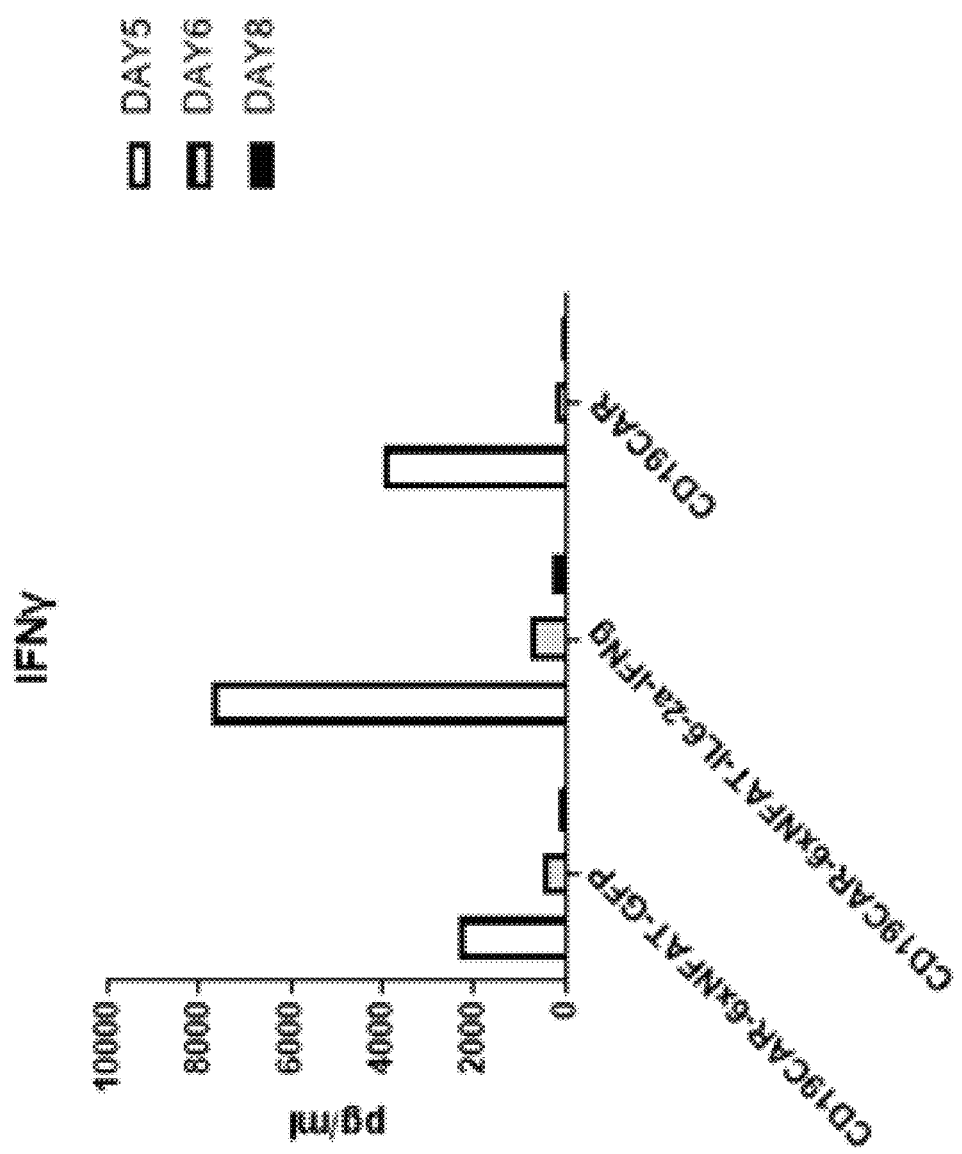
FIG. 22 shows IFNγ (i.e., IFNg) release in response to CD3/CD28 Dynabeads activation.

FIG. 22 shows IFNγ (i.e., IFNg) release in response to CD3/CD28 Dynabeads activation. On day 0, peripheral blood of healthy volunteers was taken, CD3+ T cells were sorted, and CD3/CD28 Dynabeads were added in a 1:1 ratio. On Day 2, T cells were transfected using lentivirus including various following vectors. CD19CAR T cells were infected according to the infection ratio of MOI=10:1; hCD19CAR, hCD19CAR-6×NFAT-GFP, hCD19CAR-6×NFAT-GFP, hCD19CAR-6×NFAT-IL6-2a-IFNg cells were infected according to the infection ratio of MOI=60:1. The lentivirus was removed, and the cells were resuspended in fresh medium. On DAY 5, 6, and 8, 200 ul of the cell supernatant was used to detect the release of IFNγ. On Days 5 and 6, cells were cultured with CD3/CD28 Dynabeads such that the cells were activated, and NFAT element was activated which enabled the transcription of IFNγ and the release of IFNγ. However, on Day 8, the effect of Dynabeads stimulation has dropped to a lower level, and the cells were no longer activated. Therefore, the NFAT element was turned off and transcription of IFNγ was disabled. Thus, IFNγ was not released. When T cells are stimulated by CD3/28 Dynabeads, the cells are activated for a short period of time. The NFAT element causes transcriptional translation of the gene in response to the activation, and the corresponding genes are expressed. When the cells are at rest or at a lower level of activation, the NFAT element does not initiate transcriptional translation of the gene of interest. Therefore, whether the NFAT element is active or not and whether the induced gene is expressed can be determined by the expression of the target gene in the activated and inactivated state of the CAR-T cell.

Figure 23:
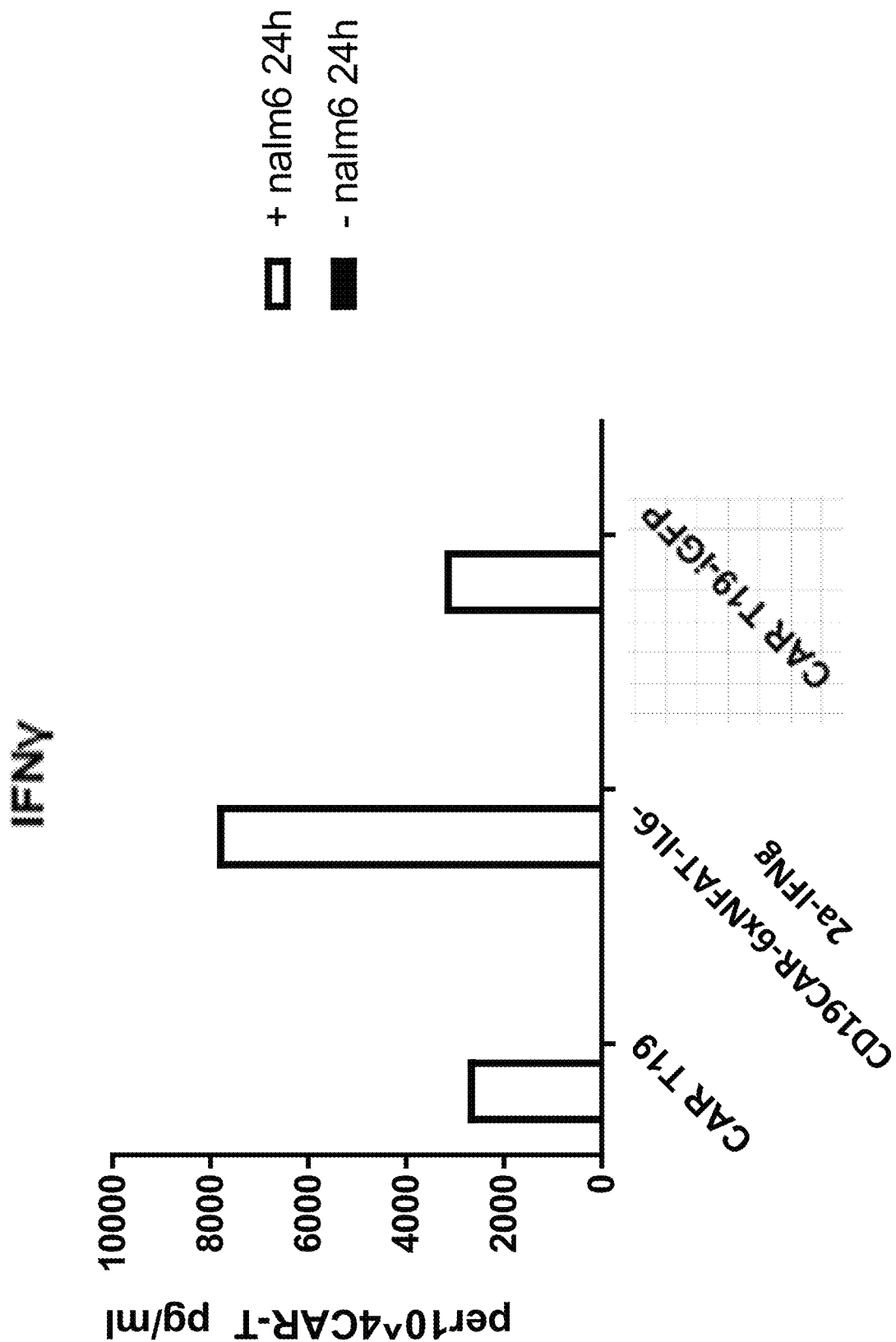
FIG. 23 shows IFNγ release in response to co-culturing with Nalm6 cells.

FIG. 23 shows IFNγ release in response to co-culturing with Nalm6 cells (See Table below). The cells were cultured to Day 8 and then were leveled with NT cells to differentiate the CAR ratio of CD19 CAR T cells and CD19CAR-6×NFAT-GFP to cells of CD19CAR-6×NFAT-IL6-2a-IFNg. $10^4$ CAR+ cells were co-cultured with $10^4$ Nalm-6 cells or cultured separately. After 24 hrs, the supernatant was collected, and the amount of IFNγ released was measured. The cells were co-cultured with Nalm6 cells and were in an activated state. Thus, the NFAT element initiated transcription of IFNγ in an activated state, allowing IFNγ to be released. When the CAR T cells are co-cultured with the target cells, the cells are activated because the CAR T cells recognize the membrane proteins on the surface of the tumor cells. The NFAT element initiates transcriptional translation of the gene to be expressed due to the activation. The corresponding gene is expressed. When the cell is at rest or the activation level is low, the NFAT element does not initiate transcriptional translation of the gene of interest. Therefore, whether the NFAT element is active or not and whether the induced gene is expressed can be determined by the expression of the target gene in the activated and inactivated state of the CAR T cell.

TABLE 9

| CAR T cells $10^4$ | CD19CAR-T | CD19CAR-6×NFAT-GFP | CD19CAR-6×NFAT-IL6-2a- IFNγ |
|---|---|---|---|
| Co-cultured cells (25 hours) $10^4$ | Nalm6 | Nalm6 | Nalm6 |
| IFNγ released: CAR T cells co-cultured with Nalm6 | 2400-3200 pg/ml | 2400-3200 pg/ml | 7900 pg/ml |
| IFNγ released: CAR T cells cultured alone | 2400-3200 pg/ml | 2400-3200 pg/ml | 2400-3200 pg/ml |

Figure 24:
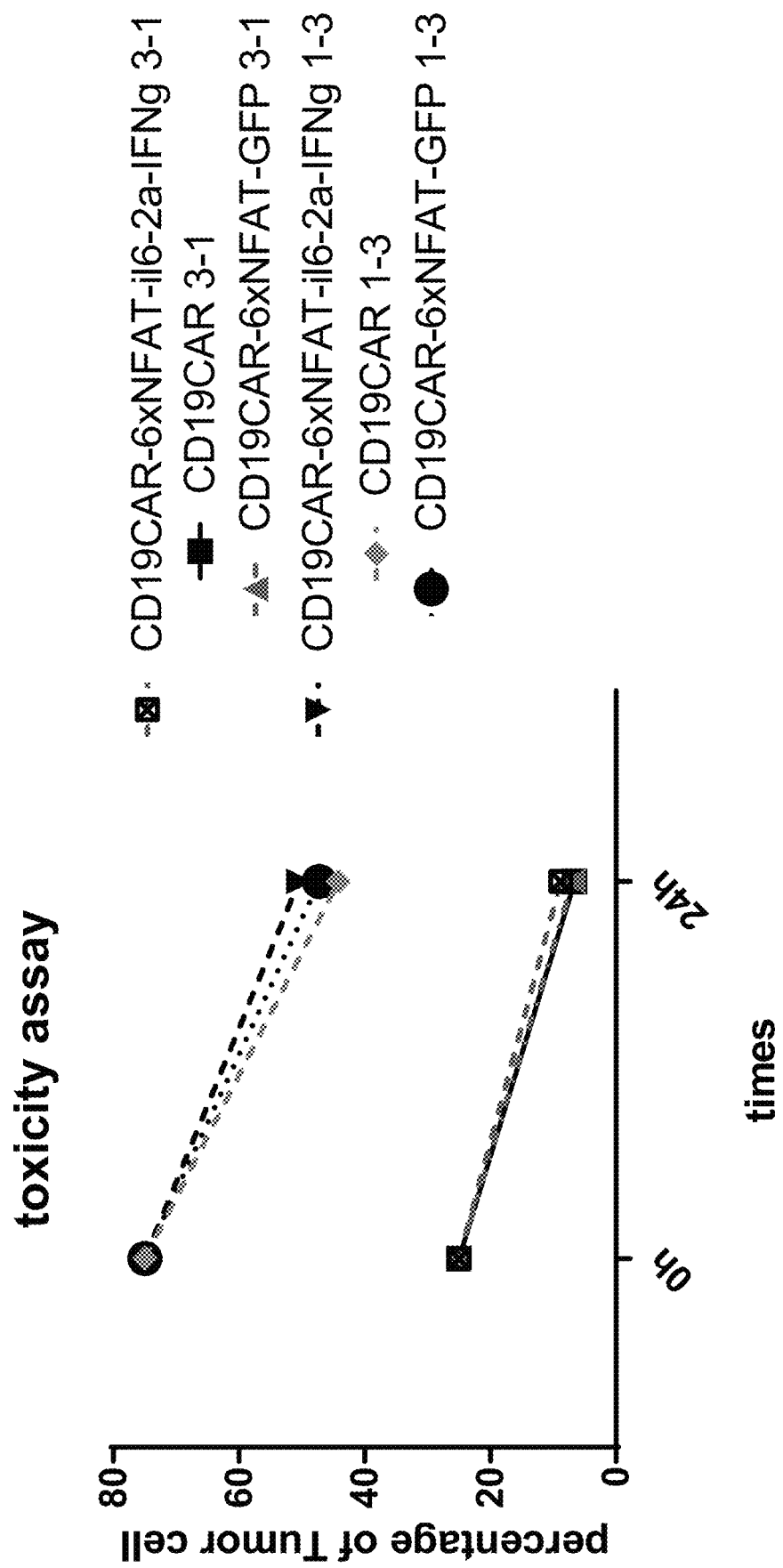
FIG. 24 shows toxicity assay with respect to CAR T cells.

FIG. 24 shows toxicity assay with respect to CAR T cells. T cells from a healthy donor were cultured to Day 8 and then were leveled with NT cells to differentiate the CAR ratio of CD19 CAR T cells and CD19CAR-6×NFAT-GFP to cells of CD19CAR-6×NFAT-IL6-2a-IFNg. 30e4 CAR+ cells were co-cultured with $10^4$ Nalm-6 cells and 90e4 Nalm-6 cells, respectively. The residual of Nalm6 cells was detected after 24 hrs. CD19CAR T cells, CD19CAR-6×NFAT-GFP cells, and CD19CAR-6×NFAT-IL6-2a-IFNg cells were co-cultured with Nalm6 cells in different ratios. There were no significant differences among the 3 cell groups. After the cells of CD19CAR, CD19CAR-6×NFAT-GFP and CD19CAR-6×NFAT-IL6-2a-IFNg were activated by the tumor, the T cells executed a killing function and acted on the target cells to cause the target cells to be killed.

Figure 25:
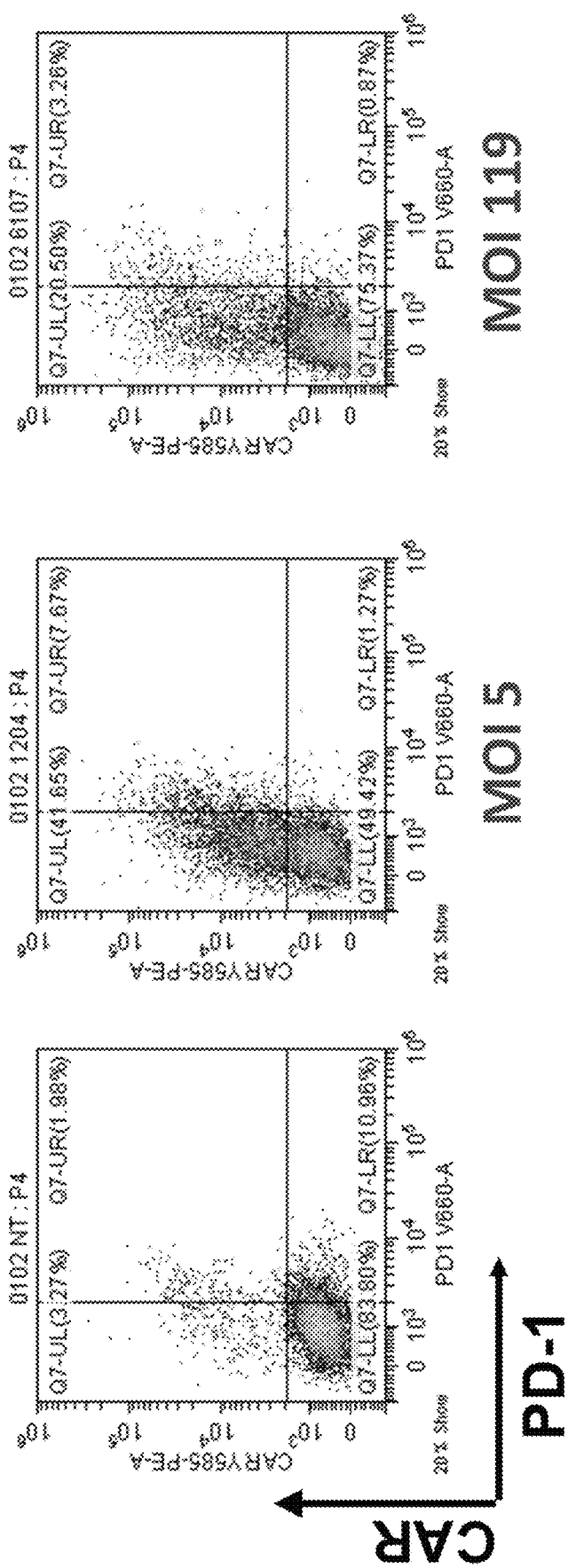
FIGS. 25 and 26 show other IFNγ release in response to co-culturing with Nalm6 cells.
Figure 26:
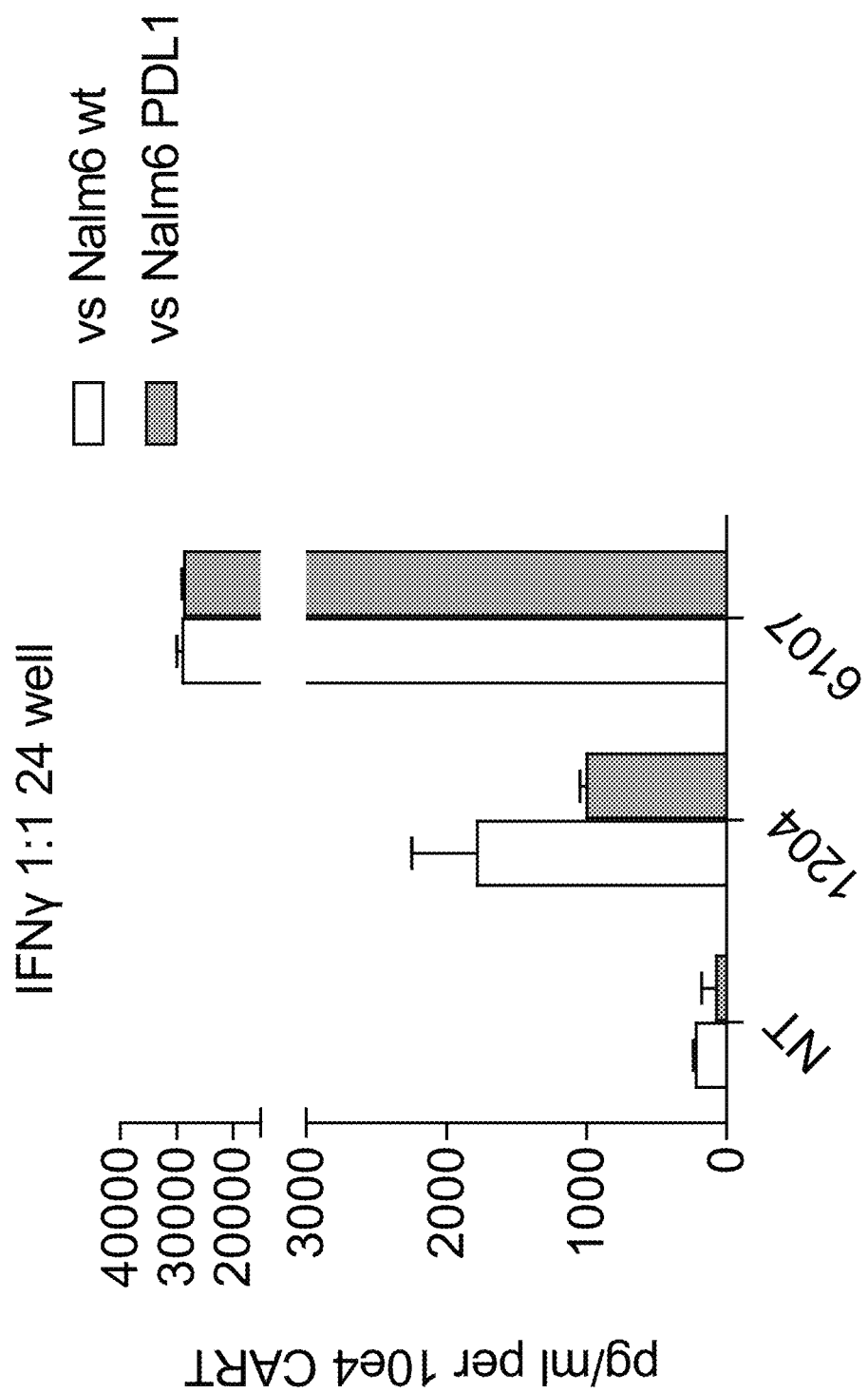

FIGS. 25 and 26 show other IFNγ release in response to co-culturing with Nalm6 cells. Day 0, peripheral blood T cells were obtained from volunteer and stimulated using Dynabeads at 1:1 ratio. Day 1 the cells were infected with lentiviral vectors. Day 2, the media were changed. Day 7 flow cytometry assays were used to detected CAR expression and CAR copy numbers. 1204 represents hCD19CAR cells, and 6107 represents hCD19CAR-2A-IL12 cells which express IL12 continuously. The CAR expression was normalized to 17%. $10^4$ CAR positive cells and $10^4$ Nalm6 or Nalm6-PDL1 tumor cells were co-cultured in 24-well plates for 24 h, and the supernatant was assayed for IFNγ. 1204 had 42% CAR expression and 1.5 copies per CART cell, and 6107 had 23% CAR expression and 0.94 copies per CART cell. CAR was normalized to 17% for co-culture. Co-culture results, as shown in the histogram, showed that IFNγ produced by Nalm6-PDL1 stimulation for 1204 was about half that stimulated by Nalm6 wt because of the inhibitory effect of PDL1 on T cells. The release of IFNγ from 6107 reached about 10 times that of 1230, demonstrating that IL12 released by CAR T significantly promoted IFNγ release.

Figure 27:
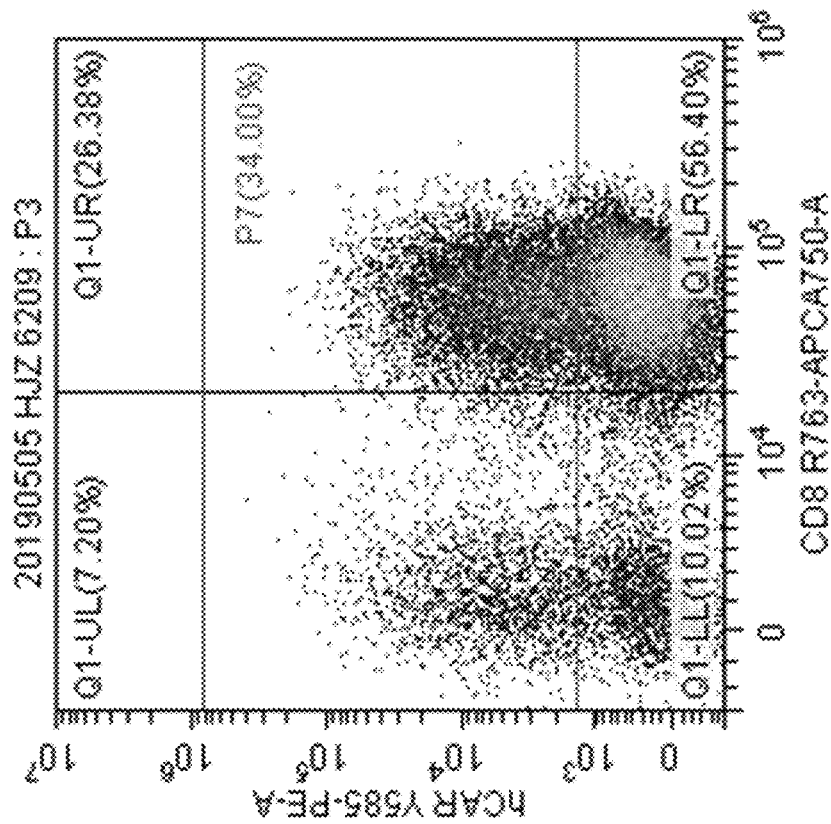
FIGS. 27 and 28 show IL12 and IFNγ release in response to CD3/CD28 Dynabeads activation.
Figure 27:
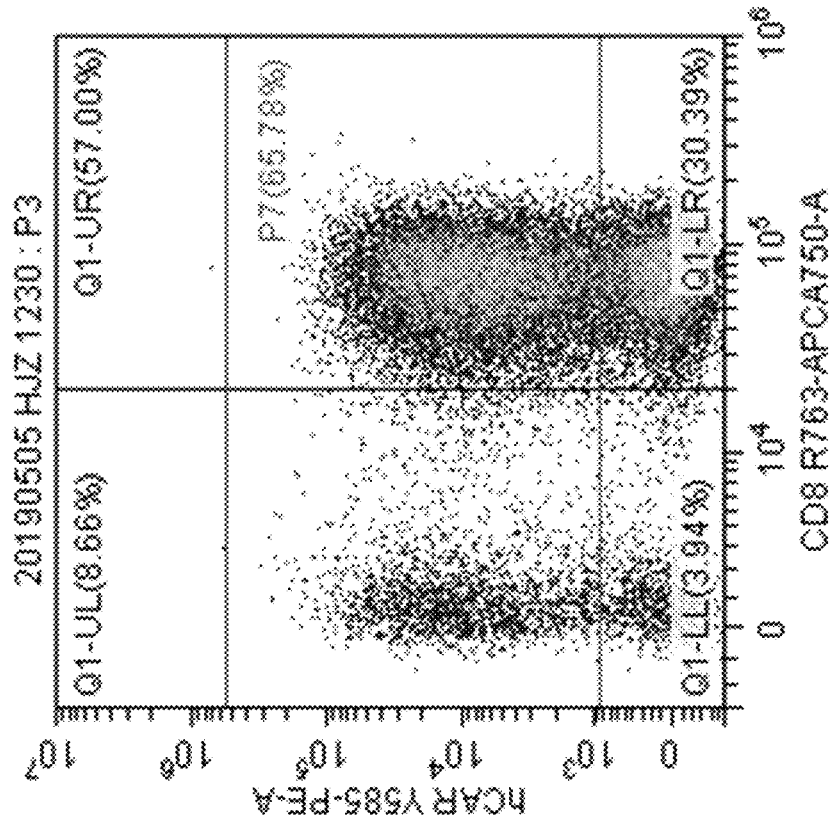
Figure 28:
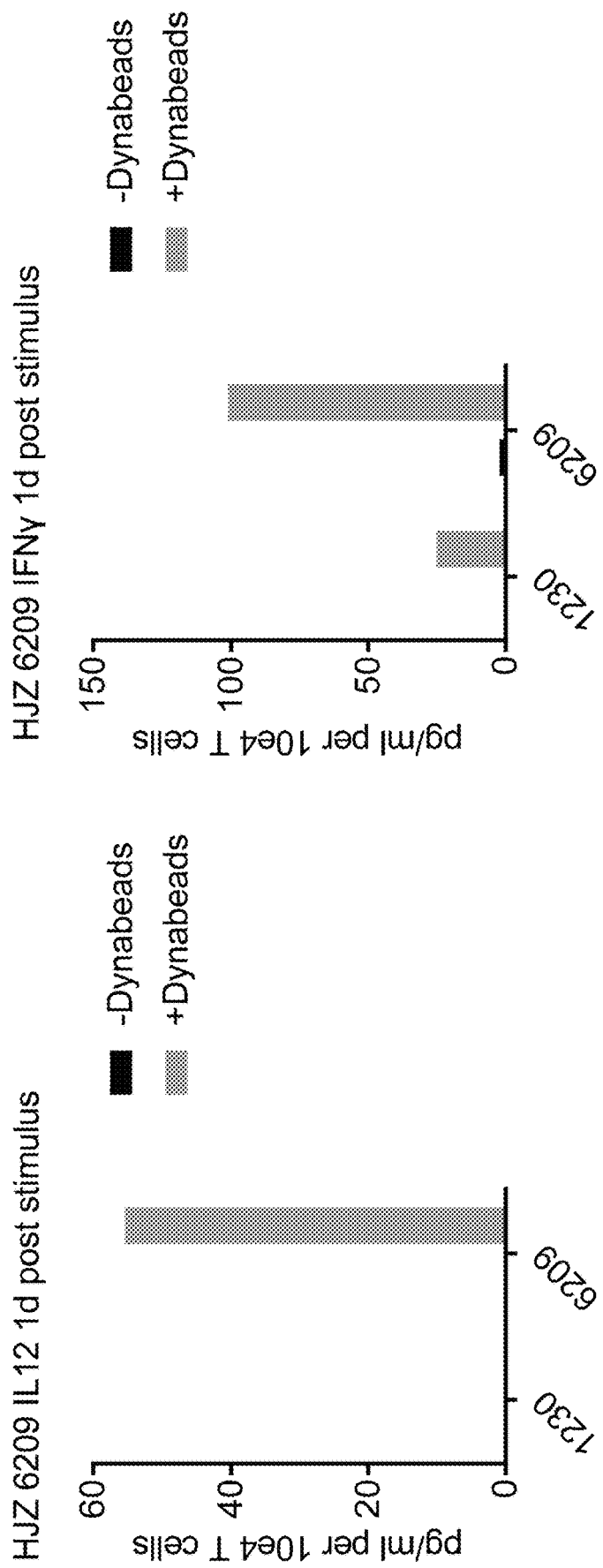

FIGS. 27 and 28 show IL12 and IFNγ release in response to CD3/CD28 Dynabeads activation. Day 0, peripheral blood T cells were obtained from volunteer and stimulated using Dynabeads at 1:1 ratio. Day 1, the cells were infected with lentiviral vectors. Day 2, the media were changed. On day 9, flow cytometry was used to detect CAR expression. 1230 represents h19CAR, and 6209 represents h19CAR-6×NFAT-IL12 (conditional release of IL12 under T cell activation). The CAR expression was normalized to 30%. The same number of cells were stimulated by Dynabeads for 24 hrs at a ratio of 1:3, and the supernatant was assayed for IL12 and IFNγ. There was 65% CAR expression in 1230 and 34% CAR expression in 6209. After normalized to 30%, add Dynabeads. After 24 hrs, the supernatant was assayed to collect information of cytokines and results were presented as a histogram. Under the stimulation of Dynabeads, 6209 released an average of 55 pg of IL12 per $10\times^4$ of T cells. 1230 did not release IL12 regardless of stimulation, and 6209 did not release IL12 without stimulation. This indicates that, originally, NFAT activated IL12 transcription under Dynabeads stimulation, as shown on the left. IFN was released as shown on the right. Both CAR T cells were free of IFNγ release without stimulation, and 6209 released more IFNγ under Dynabeads stimulation, indicating that IL12 synergizes with 6209CART cells to release more IFNγ.

Figure 29:
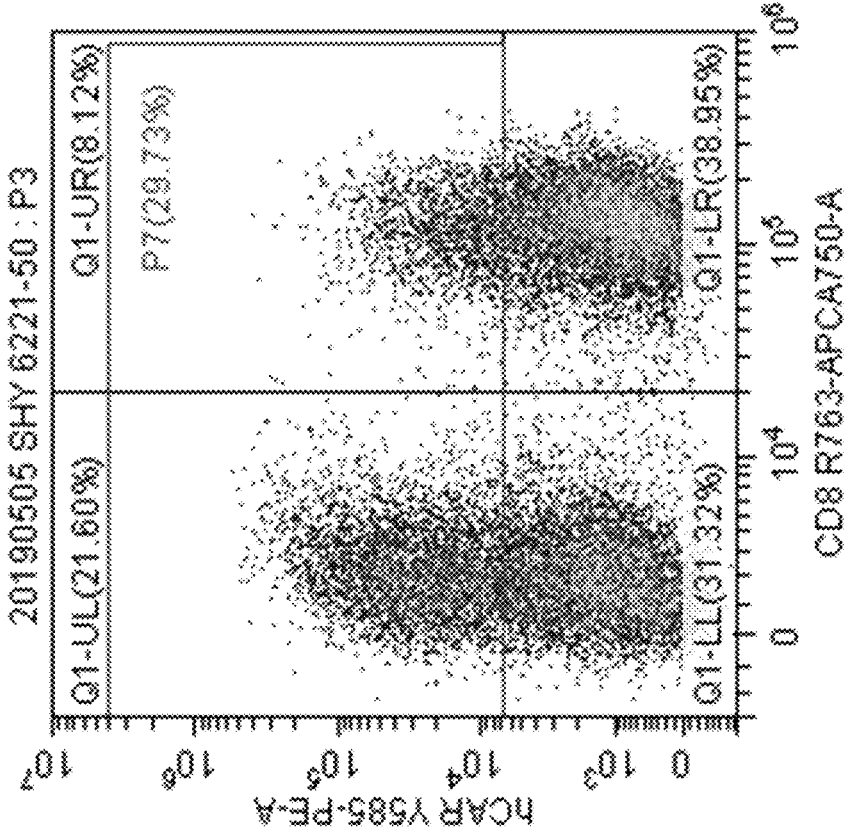
FIGS. 29 and 30 show IL6 and IFNγ release in response to CD3/CD28 Dynabeads activation.
Figure 29:
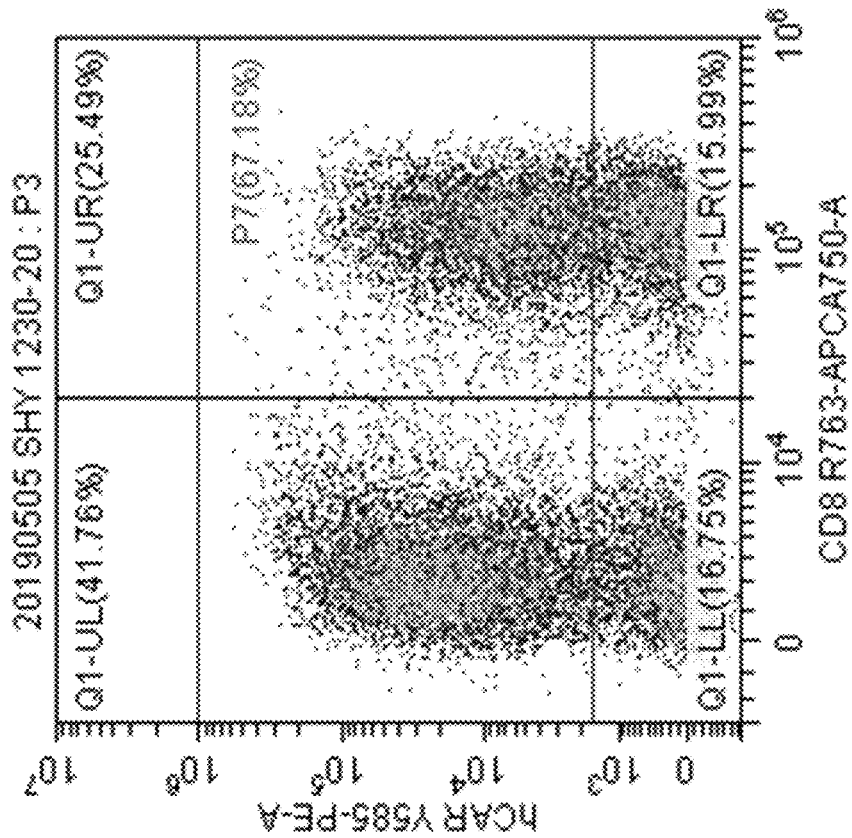
Figure 30:
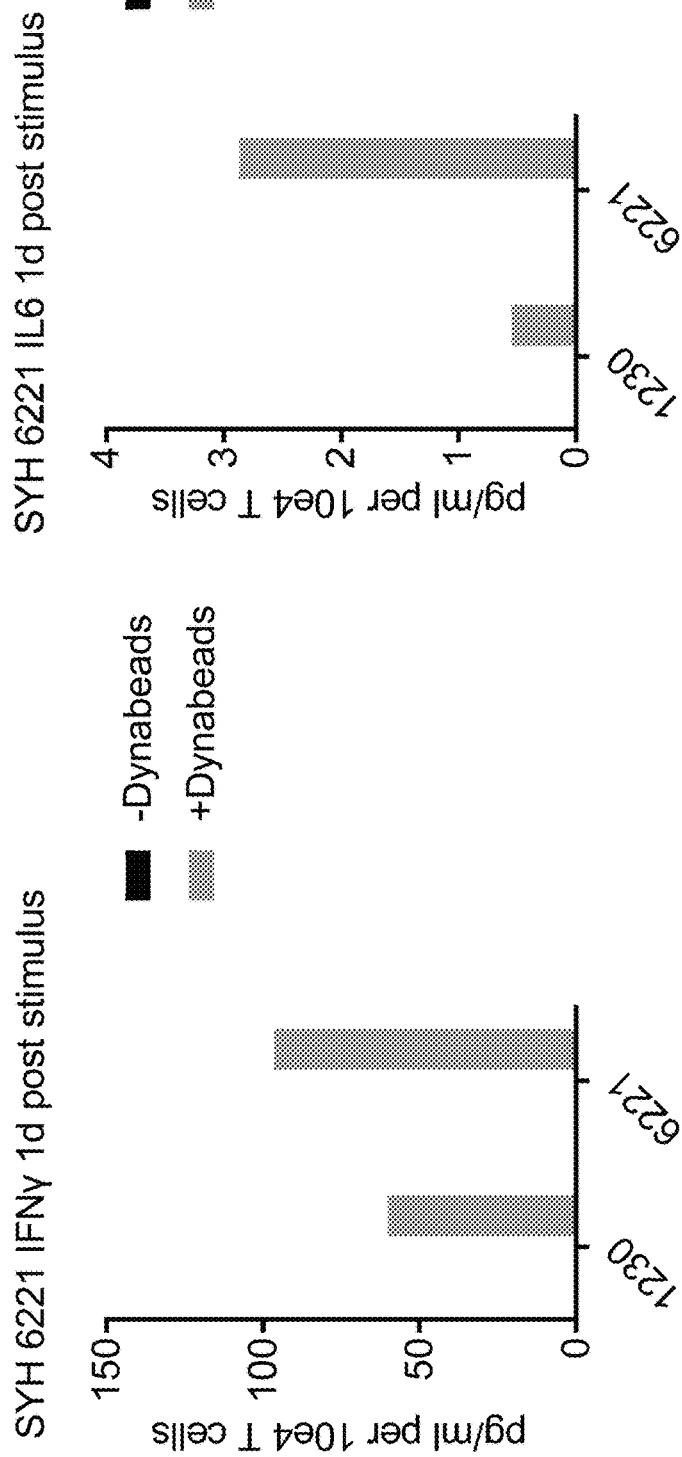

FIGS. 29 and 30 show IL6 and IFNγ release in response to CD3/CD28 Dynabeads activation. Day 0, peripheral blood T cells were obtained from volunteer and stimulated using Dynabeads at 1:1 ratio. Day 1, the cells were infected with lentiviral vectors. Day 2, the media were changed. On day 7, flow cytometry was used to detect CAR expression. 1230 represents hCD19CAR, and 6221 represents hCD19CAR-6×NFAT-IL6-2A-IFNγ (conditional release of IL6 and IFNγ under T cell activation). The CAR expression was normalized to 12.66%. The same number of cells were stimulated by Dynabeads for 24 hrs at a ratio of 1:3, and the supernatant was assayed for IL6 and IFNγ. There was 67% CAR expression in 1230, and 29% CAR expression in 6221. The CAR expression was normalized 12.66% and the cells were added Dynabeads. After 24 hrs, the supernatant was assayed to collect information of cytokines and results were presented as a histogram. Both cells were free of IL6 or IFNγ release without Dynabead activation. After addition of Dynabeads, 6221 significantly released more IL6 and IFNγ (based on the average number of pg released per $10^4$ T cells).

Cell Expansion and Treatment of Cancer

For fresh cells, after removing the magnetic beads, the transduced cells were centrifuged or replaced with a solution of 95% compound electrolyte injection of 5% human albumin, loaded into a return bag, and transported at 15-25° C. after sealing. Fresh preparations were returned directly. For Cryopreserved cells, the transduced cells were transferred to the media including a compound electrolyte injection of 33.75% human albumin 25% dextran 40 glucose injection 33.75% DMSO 7.5%. The cell suspension was loaded into a cryopreservation bag and then the procedure was cooled to −90° C. and transferred to a gas phase liquid nitrogen tank for storage. The reconstitution of the frozen preparations was completed within 30 minutes after resuscitation. Peripheral blood mononuclear cells (PBMCs) were obtained from patients by leukapheresis for CAR T cell preparation, and the first day of CAR T infusion was set as study day 0.

Patients were given a conditioning treatment for lymphodepletion. Fludarabine- and cyclophosphamide-based conditioning treatment varied according to the tumor burden in the bone marrow (BM) and peripheral blood (PB). CAR T cells were transfused to patients. Each day CAR T cells were transported to the hospital, washed, counted, checked for viability and then prepared for administration to patients, who were then observed closely for at least 2 hours. Cytokine Release Syndrome (CRS) was graded according to a revised grading system (See Lee D W. et al, Blood 2014; 124:188-95). Other toxicities during and after therapy were assessed according to the National Institutes of Health Common Terminology Criteria for Adverse Events Version 4.0 (http://ctep.cancer.gov/). Therapy responses were assessed by flow cytometry and morphological analysis. When possible, patients were assessed by chimeric gene expression levels. The response type was defined as minimal residual disease (MRD) negative, complete response, complete response with incomplete count recovery, stable disease, and progressive disease.

Figure 17:
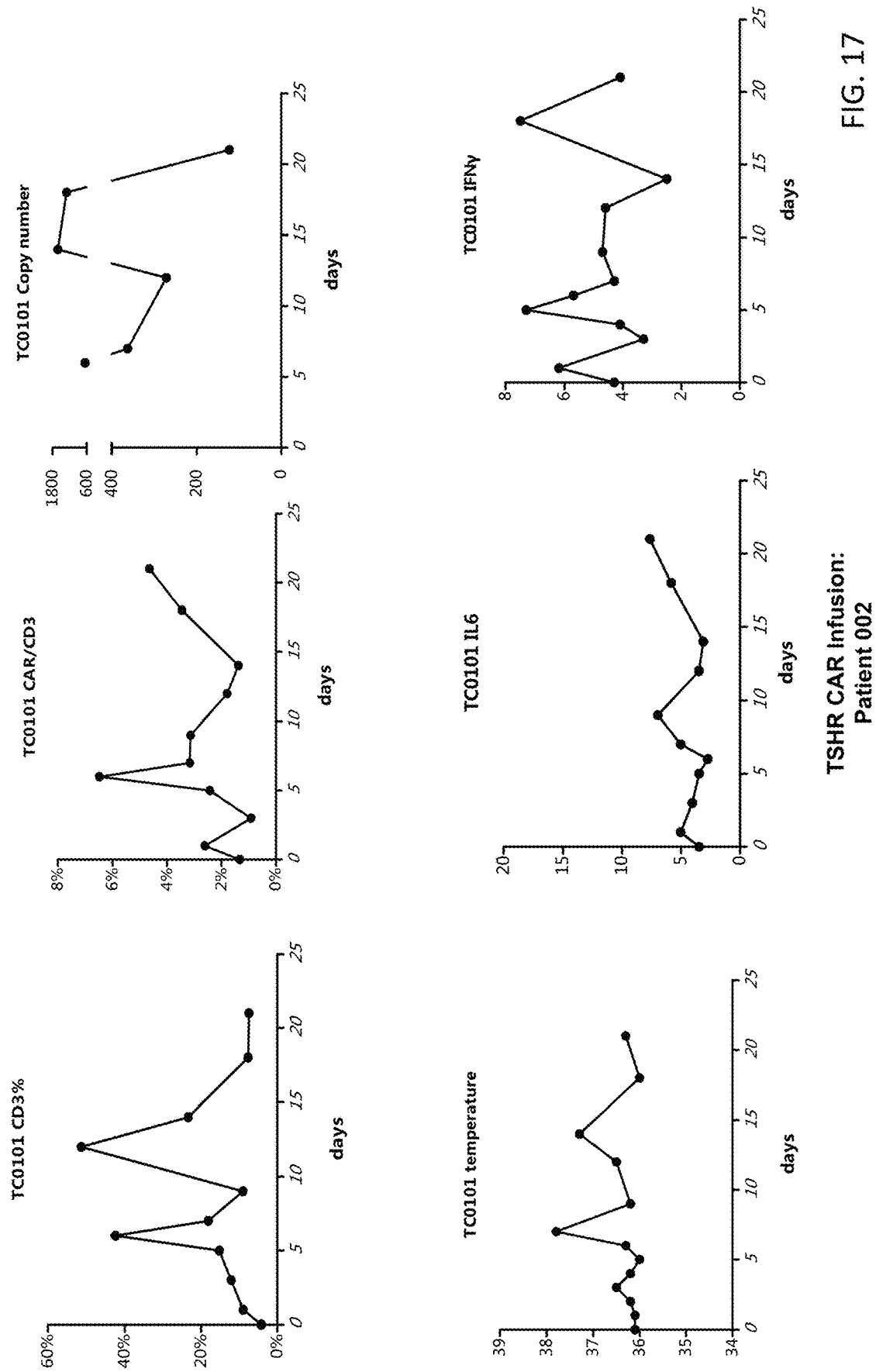
FIG. 17 shows various parameters of the patient in response to CAR T cell infusion in another patient.

Serial BM and PB samples after CAR T cell infusion were collected in K2EDTA BD vacutainer tubes (BD). The persistence of CD19CAR T cells from fresh PB and BM in patients was determined by FACS. Circulating CAR T cell numbers per μl were calculated on the basis of measured absolute CD3+ T lymphocyte counts. Simultaneously, CAR DNA copies were evaluated as another method of determining CAR T cell expansion and persistence. Genomic DNA was extracted using a QIAamp DNA Blood Mini Kit (Qiagen) from cryopreserved PB and BM. CAR DNA copies were assessed by quantitative real-time PCR as described in the supplementary materials. The levels of cytokines IFN-γ, TNF-α, IL-4, IL-6, IL-10, IL-17, etc. in serum and CSF were measured in a multiplex format according to the manufacturer's instructions (See FIGS. 12-15 and 16 as well as 17). On Day 64, PET CT scanning was performed to evaluate CAR T therapy on patient 001. Patient 001 had undergone thyroidectomy. The CT images showed that there was no clear tumor recurrence or recurrence in the surgical area. Thyroid cancer changed the bilateral thyroid surgery area after surgery, and no abnormal CT signal was observed in the area. After the scanning signal is enhanced, no abnormal enhancement signal is observed in the above areas. The double neck II and III areas showed multiple small lymph nodes with a maximum short diameter of no more than 10 mm. There were no abnormalities in the bilateral submandibular gland morphology and CT signal. At the same time, the cervical spinal cord morphology and CT signal were not abnormal. It appeared that patient has achieved complete remission (CR). FIG. 16 shows various parameters of the patient in response to CAR T cell infusion in a patient. FIG. 17 shows various parameters of the patient in response to CAR T cell infusion in another patient. These results demonstrate that T cells expressing CD19 CAR and TSHR CAR expanded more and released more cytokines (e.g., IL-6 an IFN-γ) than T cells expressing only the TSHR CAR.

Figure 11:
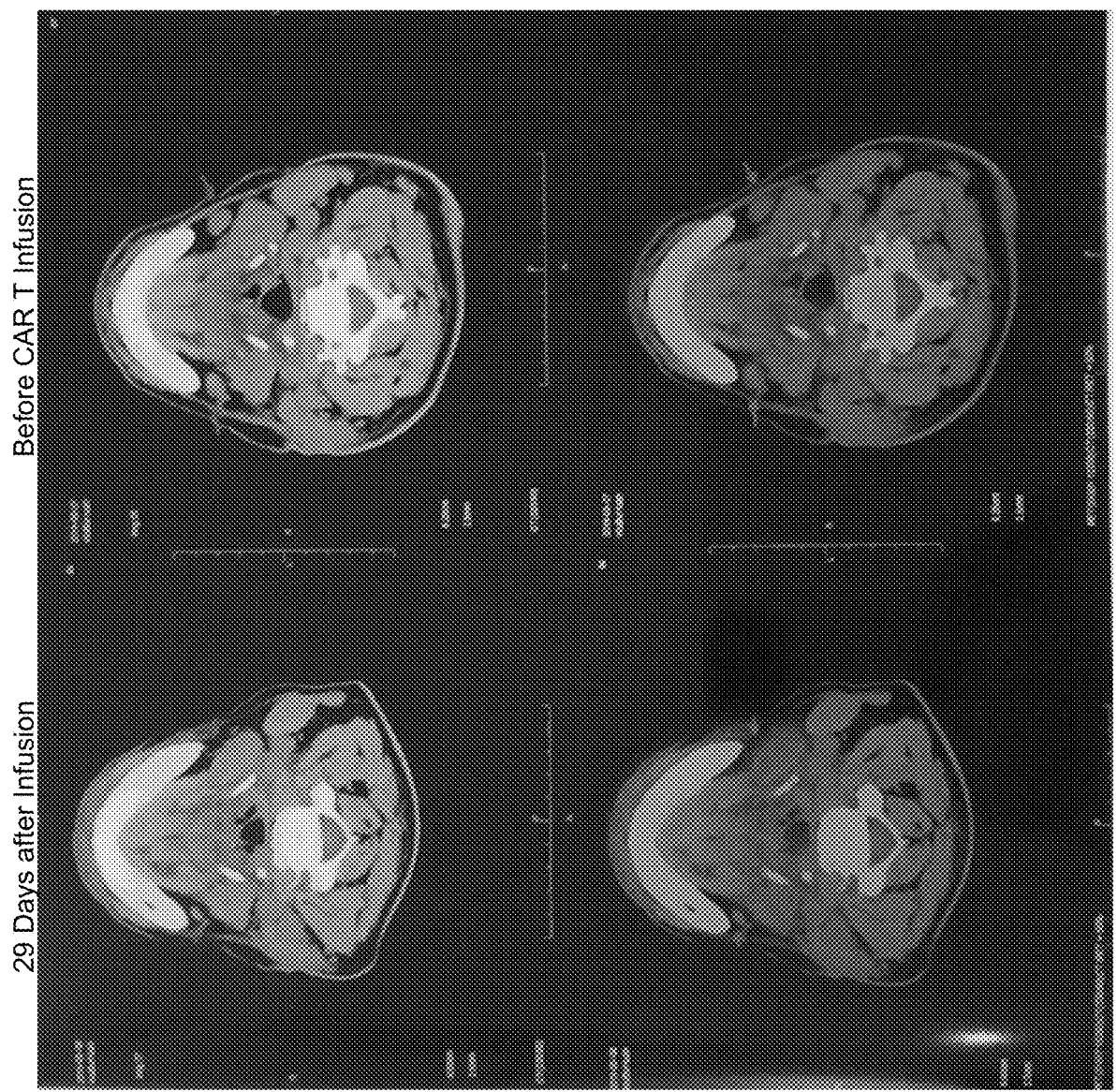
FIG. 11 shows PET/CT images showing tumor changes before and after CAR T cell infusion.
Figure 12:
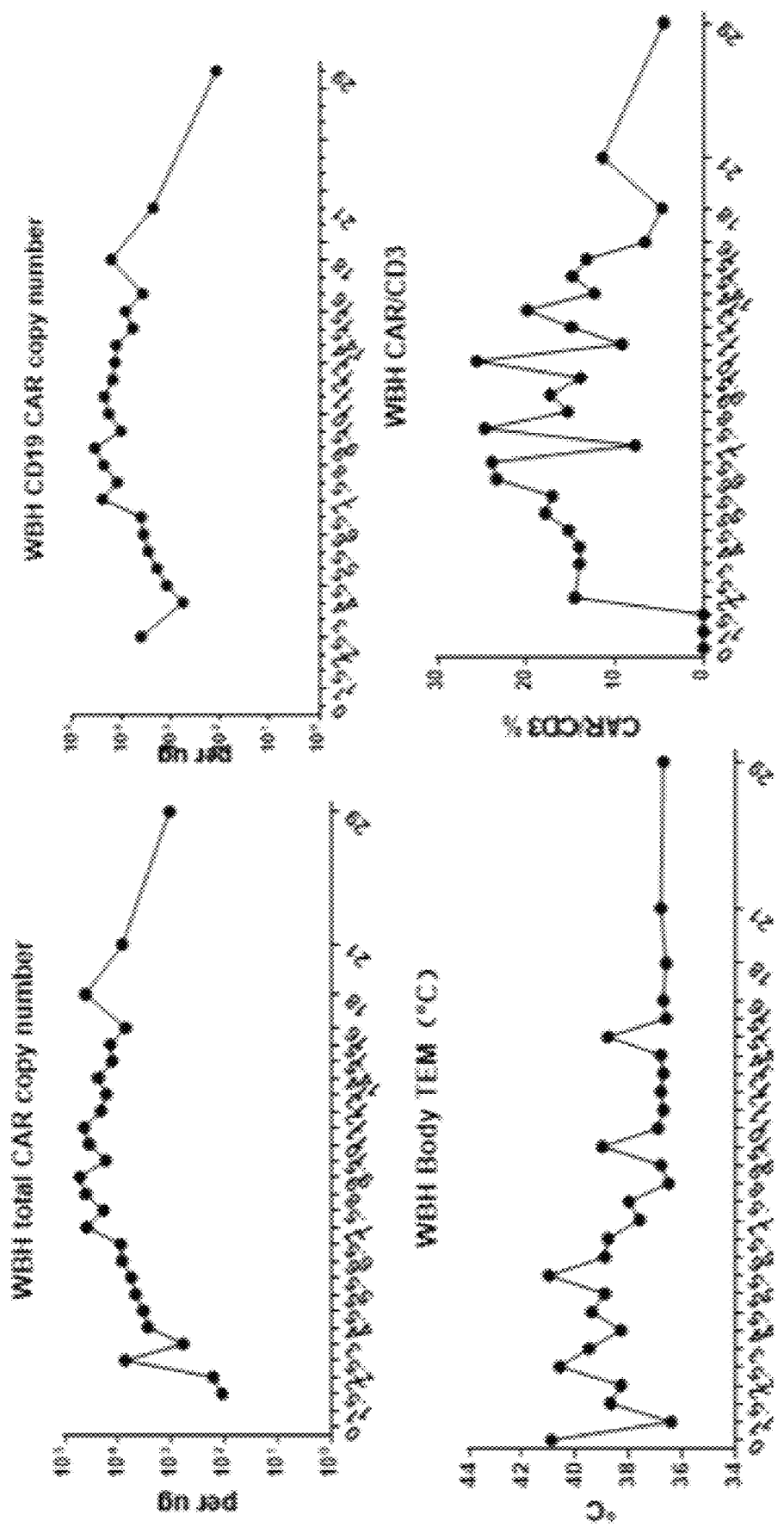
FIGS. 12, 13, 14, and 15 show changes of cytokine release and other parameters in response to CAR T cell infusion.
Figure 13:
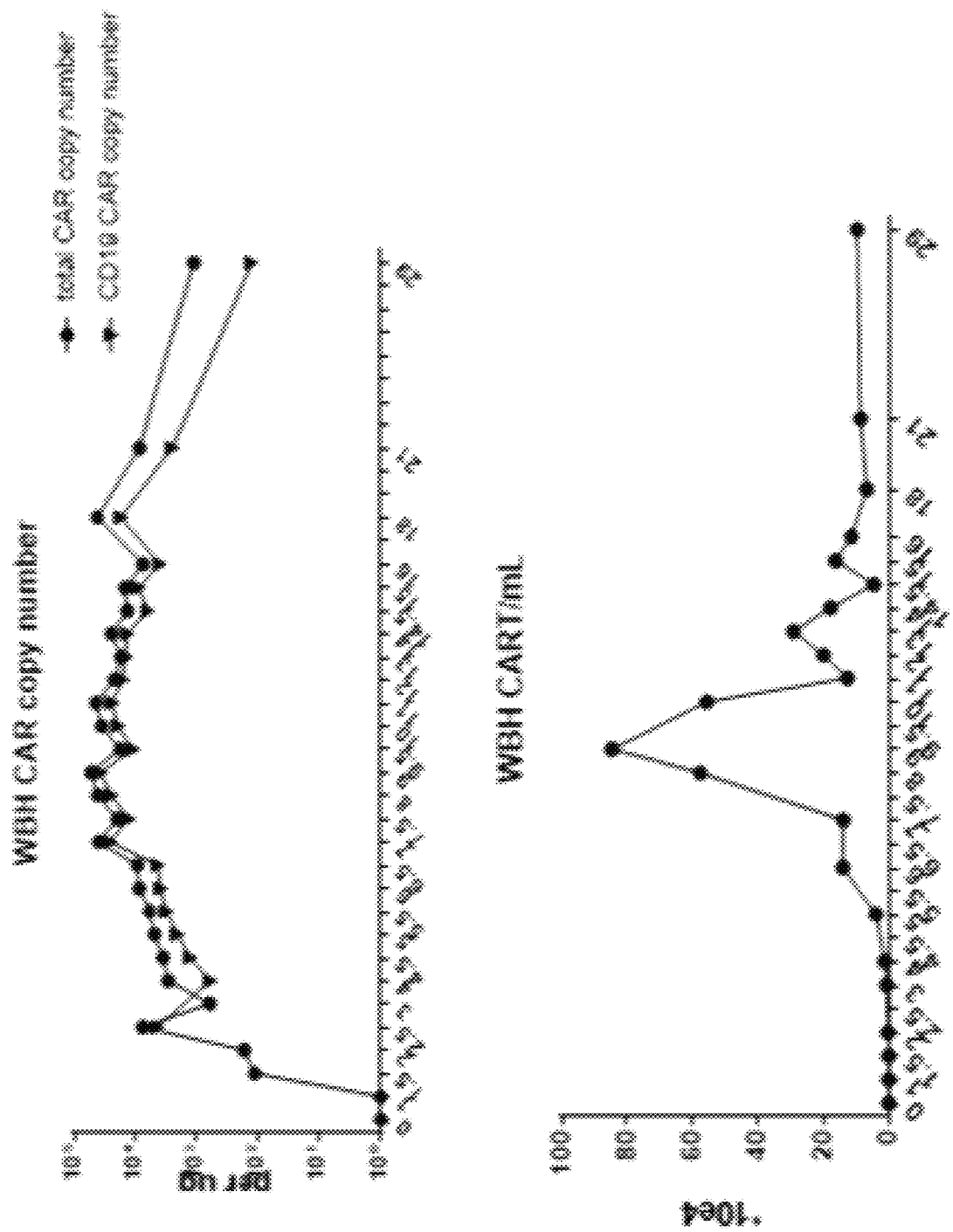
Figure 14:
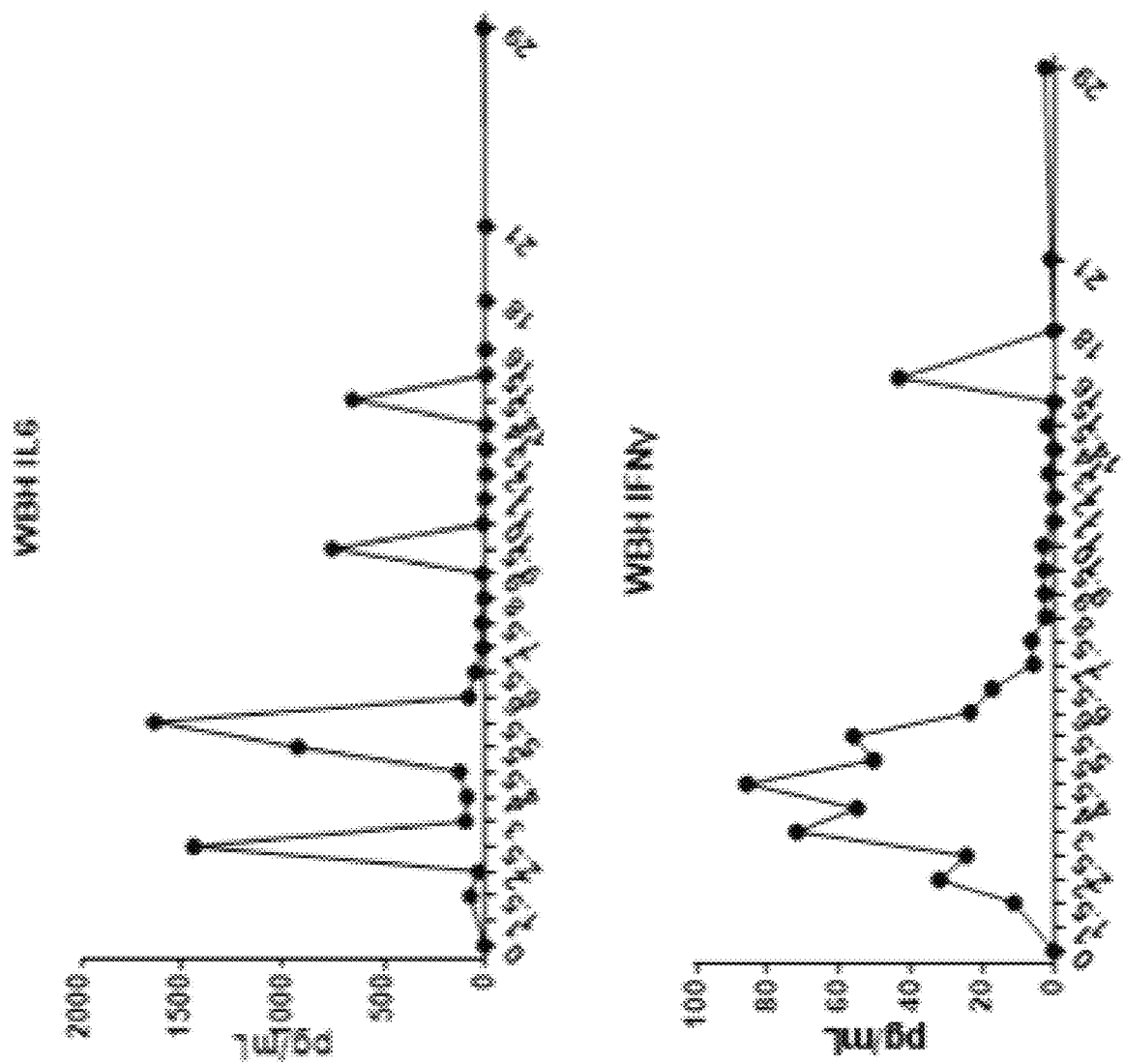
Figure 15:
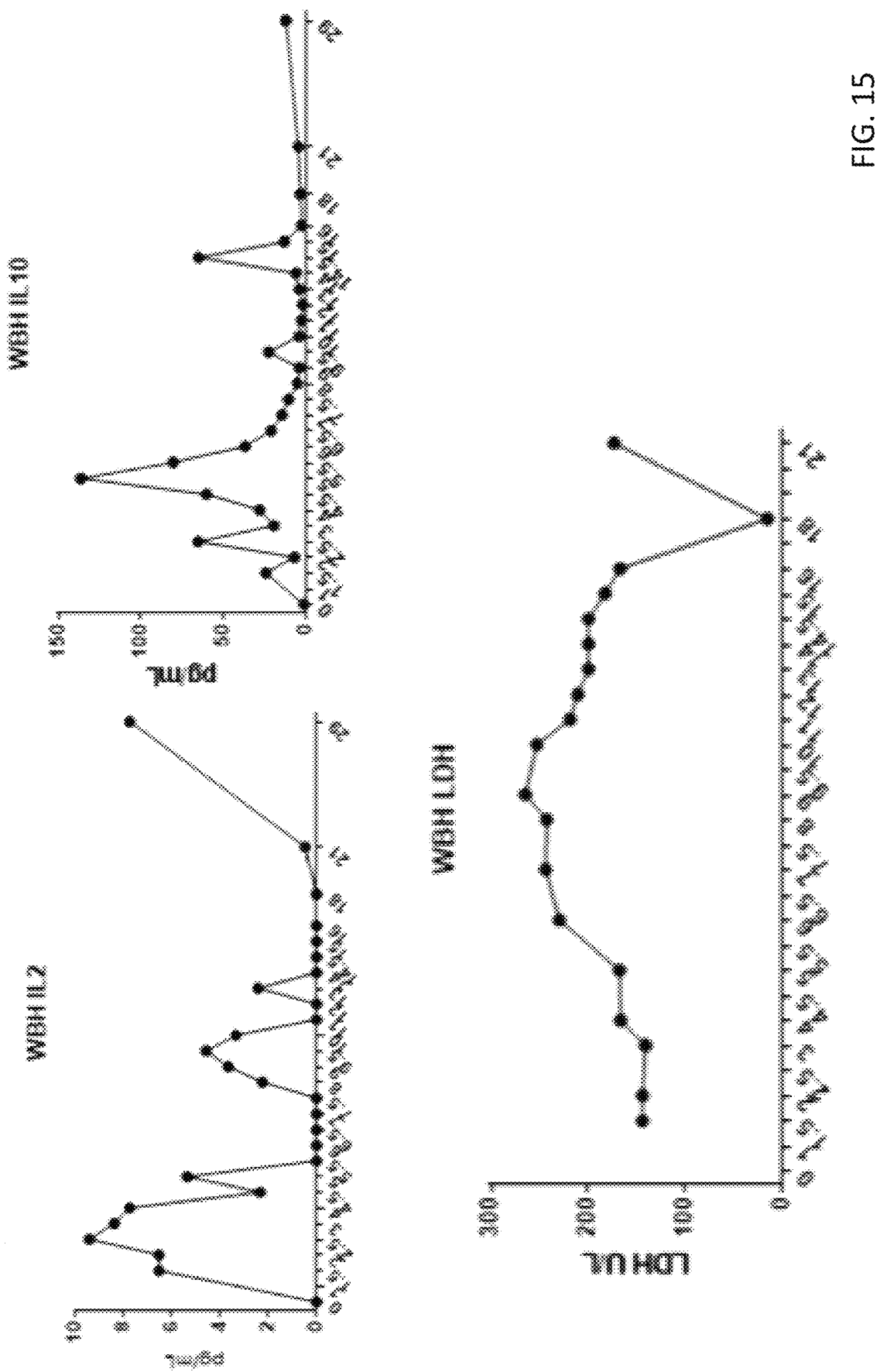

As for Patient 002, after cell infusion, while the patient did not have any adverse reaction, no apparent response (e.g., disappearance or shrink of target lesions) was observed. As for Patient 001, 29 days after the infusion, the right tumor disappeared, and the size of the left tumor reduced (See FIG. 11). These results demonstrate that T cells expressing CD19 CAR, TSHR CAR, and IL6/IFNγ enhanced or inhibited the growth of thyroid cancer. During the treatment, no severe CRS (no greater than level 2) was observed in Patient 001. This demonstrated that infusion of CAR T cells expressing and secreting IL-6 did not cause severe CRS for treating solid tumors.

Genomic DNA was extracted using a QIAamp DNA Blood Mini Kit (Qiagen) from cryopreserved peripheral blood and bone marrow. Quantitative PCR (qPCR) was performed in real-time in triplicates using the ABI 2×TaqMan Universal Master Mix with AmpErase UNG (Applied Biosystems) in a 7500 real-time PCR system (Applied Biosystems). Copy numbers per microgram of genomic DNA were calculated from a standard curve of 10-fold serial dilutions of purified CAR plasmid containing 102-108 copies/μL. Amplification of an internal control gene was used for normalization of DNA quantities (See FIG. 16). Primers/probes specific for the CAR19 transgene and an internal control gene were as previously described (see Gökbuget N. et al., Blood 2012; 120:2032-41 and O'Brien S. et al, J Clin Oncol 2013; 31:676-83).

Cells Expressing Chimeric Receptors Establish Antitumor Effects in Patients with Relapsed/Refractory Acute Lymphocytic Leukemia This clinical trial was designed to assess the safety and efficacy of infusing autologous T cells modified to express CD19 specific CAR/4-1BB/CD3-ζ into Chinese patients with R/R ALL. The inclusion criteria were as follows: 1) age not more than 60 years; 2) relapsed or refractory CD19+ ALL; 3) relapsed allo-HSCT without evidence of graft versus host disease (GVHD) and not requiring immunosuppression therapy; and 4) measurable disease and adequate performance status and organ function. Patients with central nervous system leukemia (CNSL) were ineligible. The protocol was approved by the Institutional Review Board. All patients provided written, informed consent.

The single chain fragment variable (scFv) sequence specific for CD19 was derived from Clone FMC63 (See Zola H. et al, Immunol Cell Biol 1991; 69:411-22.). The 4-1BB co-stimulatory domain, CD3ζ signaling domain and hinge and transmembrane domain were generated. CART19-4-1BB vectors harboring anti-CD19 scFv (SEQ ID: 6) and the human 4-1BB and CD3ζ signaling domains were cloned into a lentiviral backbone as previously described (See Hu Y. Journal of Hematology & Oncology 2016; 9: 70).

Lentivirus was produced by transfecting 293T cells with CART19-4-1BB vectors and viral packaging plasmids which were frozen in −80° C. and thawed immediately before transduction. The lentivirus supernatant was harvested. CD3+ T cells were isolated and activated as described (See Kalos M. et al, Sci Transl Med 2011; 3:95ra73). The cells were then cultured in X-VIVO 15 medium (Lonza) containing 100 U/ml interleukin-2 (IL-2) and transduced with lentivirus supernatant at high multiplicity of infection (MOI) from 5:1 to 10:1 within 24-48 hours. The CAR transduced T cells (CD19-CAR T cell, thereafter "CART19") were obtained and cultured for 11 days. Three days before administration, fresh culture media were replaced. After that, no manipulation was conducted to the cells until transportation for infusion. The transduction efficiency was evaluated by flow cytometry (FACS) on day 5-7 after lentivirus transduction. The following anti-human antibodies were used: anti-hCD45 APC (BD Bioscience), anti-hCD3 FITC (BD Bioscience), biotin-labeled goat-anti-mouse IgG specific for F(ab')2 fragment (Jackson immunoResearch, Cat #115-065-072) and PE streptavidin (BD Bioscience). Data acquisition was performed using a CytoFLEX flow cytometer (Beckman).

Prior to CD19CAR T infusion, FACS analysis of transduction efficiency and in vitro cytotoxicity assays of CD19 CAR T were performed for each patient as described herein. Additionally, CD19CAR T cultures were checked twice for possible contaminations by fungus, bacteria, mycoplasma, chlamydia and endotoxin. Peripheral blood mononuclear cells (PBMCs) were obtained from patients by leukapheresis for CD19CAR T preparation on day 8, and the first day of CD19CAR T cell infusion was set as study day 0. Patients were given a conditioning treatment for lymphodepletion. Fludarabine- and cyclophosphamide-based conditioning treatment varied according to the tumor burden in the bone marrow (BM) and peripheral blood (PB). CD19CAR T cells were transfused directly to patients in escalating doses over a period of 3 consecutive days without any premedication. Each day CD19CAR T cells were transported to hospital, washed, counted, checked for viability and then prepared for administration to patients, who were then observed closely for at least 2 hours. CRS was graded according to a revised grading system (See Lee D W. et al, Blood 2014; 124:188-95). Other toxicities during and after therapy were assessed according to the National Institutes of Health Common Terminology Criteria for Adverse Events Version 4.0 (http://ctep.cancer.gov/). Therapy responses were assessed by flow cytometry and morphological analysis. When possible, patients were assessed by chimeric gene expression levels. The response type was defined as minimal residual disease (MRD) negative, complete response, complete response with incomplete count recovery, stable disease and progressive disease.

Serial BM and PB samples after CD19CAR T cell infusion were collected in K2EDTA BD vacutainer tubes (BD). The persistence of CD19CAR T cells from fresh PB and BM in patients was determined by FACS. Circulating CD19CAR T cell numbers per μl were calculated on the basis of measured absolute CD3+ T lymphocyte counts. Simultaneously, CAR DNA copies were evaluated as another method of determining CD19CAR T cell expansion and persistence. Genomic DNA was extracted using a QIAamp DNA Blood Mini Kit (Qiagen) from cryopreserved PB and BM. CAR DNA copies were assessed by quantitative real-time PCR as described in the supplementary materials.

The levels of cytokines such as IFN-γ, TNF-α, IL-4, IL-6, IL-10, IL-17, etc. in serum and CSF were measured in a multiplex format according to the manufacturer's instructions. Comparisons of continuous variables and risk factors that may influence variations in grade 3 or 4 CRS development were compared using the Mann-Whitney U test for 2 groups. Fisher's exact test was used to evaluate the influence of categorical variables on grade 3 CRS between 2 groups. Correlations were calculated using a rank-based Spearman test. Overall survival (OS) and leukemia-free survival (LFS) probabilities were determined by the Kaplan-Meier method using all enrolled patients to determine OS and those with MRD-negative responses for LFS. All quoted P values are two sided, and P values less than 0.05 were considered statistically significant.

CD19+-RFP and Red Fluorescent Protein (RFP) were lentivirally transduced into K562 to produce CD19-RFP-K562 cells and K562-RFP cells, respectively. The cytotoxic activity of the CD19CAR T cells was measured before infusion by co-culture with the target cells, CD19-RFP-K562 cells or K562-RFP cells, at varying ratios of effector cell to target cell (E:T). The target cells were plated into 96-well microwell plates (Nunc) at $10^4$ cells per well in 50 μl of RPMI 1640 media supplemented with 10% FBS (Gibco). The CD3/CD28 beads were removed, and effector T cells were mixed with target cells in the wells at the indicated E:T ratio. The total volume was 200 μl per well. After 24 hrs of incubation, the cells were pipetted up and down in the 96-well microwell plates with a multi-channel pipettor to dissociate the cells into single-cell suspensions. The surviving RFP target cells in each well were photographed, and the number of surviving RFP target cells was counted and compared with those in the wells without effector cells. The cell death rate was calculated as (control-sample)/control×100%. Supernatants were also collected and quantified using the human IFN-γ Valukine ELISA Kit (R&D systems).

Genomic DNA was extracted using a QIAamp DNA Blood Mini Kit (Qiagen) from cryopreserved peripheral blood and bone marrow. Quantitative real-time PCR was performed in triplicate using the ABI 2× TaqMan Universal Master Mix with AmpErase UNG (Applied Biosystems) in a 7500 real-time PCR system (Applied Biosystems). Copy numbers per microgram of genomic DNA were calculated from a standard curve of 10-fold serial dilutions of purified CAR plasmid containing 102-108 copies/μL. Amplification of an internal control gene was used for normalization of DNA quantities. Primers/probes specific for the CART19 transgene and an internal control gene were as previously described (See Gökbuget N. et al., Blood 2012; 120:2032-41 and O'Brien S. et al, J Clin Oncol 2013; 31:676-83).

Therapy response was assessed by flow cytometry and morphology. When possible, chimeric gene expression levels were assessed in the patients. The response type was defined as MRD-negative, complete response, complete response with incomplete count recovery, stable disease and progressive disease, as previously described. MRD-negative was defined as less than 0.01% marrow blasts by flow cytometry. Complete response was defined as less than 5% marrow blasts, absence of circulating blasts, and no extramedullary sites of disease with absolute neutrophil counts of 1000 per μL or more and platelets 100,000 per μL or more. Complete response with incomplete count recovery was defined as a complete response with cytopenia. Stable disease was defined as disease that did not meet the criteria for complete response, complete response with incomplete count recovery, or progressive disease. Progressive disease was defined as worse M status or no change in M status but a greater than 50% increase in absolute peripheral blast count. After CART19 therapy, patients were followed up every week and underwent bone marrow examination including morphology, MRD status, chimeric gene expression, and a CART cell count every 4 weeks.

The samples were collected in gel tubes and stored at 4° C. until centrifugation later the same day. All blood and CSF samples were then centrifuged at 5000 rpm for 6 minutes. The supernatants were transferred for subsequent analysis. The BD Cytometric Bead Array Human Th1/Th2/Th17 Cytokine Kit (BD Biosciences), FCAP Array v3.0 software (BD Biosciences), and a BD FACS CANTO II (BD Biosciences) were used for the measurement and analysis of the concentrations of the cytokines such as IL-2, IL-4, IL-6, IL-10, IL-17A, IFN-γ, and TNF-α et al., according to the manufacturer's instructions.

Erythrocyte-lysed whole BM samples were used for immunophenotyping on the day of bone marrow aspiration. Antigen expression of blast cells was systematically analyzed by flow cytometry (FACSCalibur flow cytometer, BD Biosciences, San Jose, Calif.) using four-color combinations of monoclonal antibodies (mAbs) with fluorescein isothiocyanate (FITC), phycoerythrin (PE), allophycocyanin (APC), and phycoerythrin-cyanin 7 (PE-Cy7). Cell-Quest software (Becton Dickinson Biosciences) was used for data analysis. Monoclonal antibodies were purchased from the following manufacturers: BD Biosciences, CD10-APC, CD19-FITC, CD22-PE, CD34-PE, CD45-PE-Cy7, cyCD79a-PE, surface immunoglobulin (slg) M-PE, cytoplasmic immunoglobulin (clg) M-APC; Beckman Coulter, CD20-APC, slg-Lamda-FITC, slg-Kappa-APC.

For the investigation of Minimal residual disease (MRD), the combination of mAbs was based on the aberrant phenotypes of leukemic blasts at diagnosis individually, and at least 500,000 events were acquired. The MRD result was presented as the percentage of cells with aberrant phenotypes among nucleated cells. A sensitivity of 0.01% was achieved in all samples analyzed. The instrument setup was calibrated daily by analyzing Calibrite™ beads and standard blood samples (BD™ Multi-Check Control from BD Biosciences or CD-chex™ Plus from Streck, Inc.) for quality control.

Three patients with relapsed/refractory Chronic Lymphocytic Leukemia (r/r ALL) were treated with CD19-CAR T cells. Results are summarized below in Tables 10-13. These results demonstrate that T cells expressing CD19 CAR establish antitumor effects in patients with r/r ALL. In addition, IL-6 and IFNγ were significantly elevated in the blood of three patients after transmission of CD19 CART cells compared to other factors (Tables 11-13). Therefore, in order to help CAR T cells achieve therapeutic effects in hematoma in the treatment of solid tumors, IL-6 and IFNγ were first selected to be expressed or overexpressed in modified T cells for treating solid tumors.

TABLE 10

| Patient ID | Tumor type | CART Dosage ($\times 10^6$/kg) | Response | CRS grade |
|---|---|---|---|---|
| JPDX | B-ALL | 4.8 | MRD (−) | 3 |
| FPCY | B-ALL | 1.7 | MRD (−) | 4 |
| SPJP | B-ALL | 2.8 | MRD (−) | 3 |

TABLE 11

| JPDX Days after infusion | IL2 pg/mL | IL4 pg/mL | IL6 pg/mL | IL10 pg/mL | TNFa pg/mL | IFNγ pg/mL |
|---|---|---|---|---|---|---|
| 1 | 13.56 | 1.11 | 18.62 | 6.58 | 0.96 | 36.55 |
| 2 | 3.44 | 1.53 | 30.56 | 8.28 | 1.4 | 103.06 |
| 3 | 7.89 | 1.11 | 624.56 | 14.2 | 1.76 | 135.28 |
| 4 | 1.3 | 1.13 | 280.87 | 18.28 | 1.97 | 65.3 |
| 5 | 7.43 | 3.35 | 211.72 | 30.69 | 3.86 | 66.9 |
| 6 | 2.64 | 1.5 | 105.56 | 10.78 | 0.75 | 16.97 |
| 7 | 0 | 0 | 57.22 | 8.25 | 0 | 7.27 |
| 9 | 6.79 | 1.5 | 263.59 | 12.6 | 1.37 | 38.78 |
| 14 | 5.12 | 1.5 | 566.55 | 9.13 | 0 | 28.31 |
| 21 | 0 | 1.86 | 35.15 | 5.02 | 0.95 | 0 |
| 33 | 6.24 | 2.96 | 12.91 | 10.38 | 1.11 | 1.84 |

TABLE 12

| FPCY Days after infusion | IL2 pg/mL | IL4 pg/mL | IL6 pg/mL | IL10 pg/mL | TNFa pg/mL | IFNγ pg/mL | IL-17A pg/mL | IL-1a pg/mL | IL-1β pg/mL | GM-CSF pg/mL |
|---|---|---|---|---|---|---|---|---|---|---|
| 1 | 6.66 | 2.56 | 30.9 | 12.92 | 3.64 | 5.27 | 6.63 | 1.5 | 2.52 | 2.31 |
| 2 | 7.82 | 3.33 | 19 | 19.7 | 3.61 | 2.29 | 6.37 | 2.32 | 3.12 | 7.29 |
| 3 | 2.43 | 0.28 | 13.08 | 22.44 | 0.29 | 1.51 | 0.86 | 0.19 | 0.55 | 0.4 |
| 4 | 0 | 0 | 10.5 | 26.61 | 0 | 1.1 | 0 | 0 | 0 | 0 |
| 5 | 3.12 | 1.14 | 23.46 | 68.66 | 1.53 | 5.94 | 2.89 | 0.71 | 1.04 | 0.87 |
| 6 | 7.15 | 1.56 | 209.49 | 247.4 | 1.93 | 41.68 | 3.91 | 0.71 | 1.23 | 1.77 |
| 7 | 10.25 | 1.78 | 664.58 | 561.46 | 2.19 | 189.95 | 3.4 | 0.71 | 1.38 | 4.71 |
| 8 | 3.51 | 1.56 | 2820.04 | 212.49 | 2.03 | 37.74 | 2.89 | 0.61 | 2 | 1.29 |
| 9 | 0.8 | 0 | 132.57 | 7.48 | 0 | 1.1 | 0 | / | 0 | 0 |
| 10 | 0 | 0.24 | 130.16 | 5.07 | 0 | 2.13 | 0 | / | / | / |
| 12 | 4.45 | 0.35 | 74.25 | 5.13 | 0.23 | 10.72 | 0 | / | / | / |
| 13 | 0 | 0 | 49.18 | 5.86 | 0 | 2.75 | 0 | / | / | / |
| 14 | 0 | 0 | 37.61 | 6.7 | 0 | 0 | 0 | / | / | / |
| 16 | 0 | 0.29 | 63.5 | 33.9 | 0 | 2.65 | 0 | / | / | / |
| 18 | 3.51 | 0.25 | 725.22 | 266.9 | 0 | 12.24 | 0 | 0.93 | 1.53 | 0 |
| 21 | 3.57 | 0.25 | 424.71 | 76.26 | 0 | 3.15 | 0 | 0.93 | 0.64 | 0 |
| 30 | 4.33 | 1.7 | 49.76 | 4.86 | 1.76 | 4.28 | 4.25 | 0.59 | 1.37 | 1.05 |
| 62 | 4.87 | 1.7 | 11.21 | 4.86 | 1.76 | 3.34 | 3.7 | 0 | 1.16 | 0.87 |
| 90 | 3.23 | 1.2 | 8.7 | 3.83 | 0.1 | 1.88 | 2.59 | 0 | 0.29 | 0.87 |
| 120 | 0 | 0 | 6.84 | 7.46 | 0 | 0 | 0 | 0 | 0 | 0 |
| 128 | 4.34 | 0.39 | 18.42 | 7.99 | 0.7 | 1.54 | 1.28 | 0 | 0.47 | 0.15 |
| 154 | 11.11 | 2.57 | 29.99 | 11.62 | 6.55 | 2.89 | 5.04 | 0.82 | 24.83 | 1.52 |

TABLE 13

| SPJP Days after infusion | IL2 pg/mL | IL4 pg/mL | IL6 pg/mL | IL10 pg/mL | TNFa pg/mL | IFNγ pg/mL | IL1a pg/mL | IL1β pg/mL | IL15 pg/mL | IL17A pg/mL | GM-CSF pg/mL |
|---|---|---|---|---|---|---|---|---|---|---|---|
| 1 | 4.6 | 4.07 | 6.16 | 8.76 | 1.88 | 5.92 | | | | | |
| 2 | 2.21 | 2.23 | 7.59 | 7.04 | 0.7 | 2.7 | | | | | |
| 3 | 3.56 | 2.6 | 10.58 | 6.77 | 1.5 | 4.03 | | | | | |
| 4 | 4.04 | 3.7 | 12.91 | 7.04 | 0.91 | 4.01 | | | | | |
| 5 | 4.6 | 4.07 | 25.78 | 7.31 | 1.5 | 5.98 | | | | | |
| 6 | 1.54 | 1.7 | 36.8 | 6.83 | 2.5 | 13.1 | | | | | |
| 7 | 1.05 | 2.18 | 38.78 | 7.98 | 3.72 | 31.37 | 3.34 | 1.86 | 4.02 | 4.58 | 1.58 |
| 8 | 8.05 | 0.53 | 517.58 | 65.02 | 1.87 | 228.77 | 1.2 | 5.1 | 0.53 | 7.03 | 2.21 |
| 9 | 2.97 | 1.26 | 439.82 | 51.75 | 3.67 | 106.21 | 0.69 | 1.17 | 0.28 | 2.19 | 1.19 |
| 10 | 5.15 | 4.45 | 57.42 | 19.86 | 2.27 | 19.26 | / | / | / | / | / |
| 14 | 1.17 | 0.59 | 38.65 | 4.5 | 0.39 | 5.03 | / | / | / | 0 | / |
| 20 | 2.22 | 1.78 | 13.48 | 6.42 | 2.7 | 7.97 | / | / | / | 4.35 | / |
| 30 | 2.13 | 1.87 | 10.72 | 20.22 | 1.24 | 4.54 | / | / | / | 3.12 | / |
| 60 | 4.12 | 1.66 | 8.21 | 5.91 | 1.53 | 2.5 | 0.93 | 1.23 | / | 3.4 | 1.12 |
| 90 | 3.79 | 1.46 | 25.74 | 7.46 | 2.01 | 5.72 | 0.06 | 0.96 | / | 3.7 | 1.05 |
| 123 | 4.87 | 1.94 | 42.87 | 9.47 | 1.76 | 7.7 | 0 | 0.96 | / | 3.7 | 0.87 |

All publications, patents and patent applications cited in this specification are incorporated herein by reference in their entireties as if each individual publication, patent or patent application were specifically and individually indicated to be incorporated by reference. While the foregoing has been described in terms of various embodiments, the skilled artisan will appreciate that various modifications, substitutions, omissions, and changes may be made without departing from the spirit thereof.

SEQUENCE LISTING (469 sequences)

SEQ ID NO: 1 - protein, 21 aa, Artificial Sequence
  Synthesized
MALPVTALLLPLALLLHAARP

SEQ ID NO: 2 - protein, 69 aa, Artificial Sequence
  Synthesized
AKPTTTPAPRPPTPAPTIASQPLSLRPEACRPAAGGAVHTRGLDFACDIYIWAPLAGTCGVLLLSLVIT

SEQ ID NO: 3 - protein, 42 aa, Artificial Sequence
  Synthesized
KRGRKKLLYIFKQPFMRPVQTTQEEDGCSCRFPEEEEGGCEL

SEQ ID NO: 4 - protein, 112 aa, Artificial Sequence
  Synthesized
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 5 - protein, 242 aa, Artificial Sequence
  Synthesized
DIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSS

SEQ ID NO: 6 - protein, 242 aa, Artificial Sequence
  Synthesized
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 7 - protein, 237 aa, Artificial Sequence
  Synthesized
DIQMTQSPASLSVSVGETVTITCRASENIYSNLAWYQQKQGKSPQLLVYVATNLADGVPSRFSGSGSGTQYSLKINSLQSEDFGSYYCQHFWGTPYTFGGGTKLGGGGSGGGGSGGGGSEVQLQQSGAELVKPGASVKLSCTASGFNINDTYMHWVKQRPEQGLEWIGRIDPANGNTKYDPKFQGKATITADTSSNTAYLQLSSLTSEDTAVYYCARGARGSRFAYWGQGTLVTVSA

SEQ ID NO: 8 - protein, 244 aa, Artificial Sequence
  Synthesized
QSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLGGGGSGGGGSGGGGSEVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSS

SEQ ID NO: 9 - protein, 252 aa, Artificial Sequence
  Synthesized
DIVLTQSPASLAVSLGQGATISCRASKSVSTSGYTYMHWYQQKPGQPPKLLIYLASNLESGVPARFSGSGSGTDFTLNIHPVEEEDAATYYCQHSGELPPSFGGGTKLEIKRAGGGGSGGGGSGGGGSEVQLVESGGDLVKPGGSLKLSCAVSGFTFSSYGMSWVRQTPDKRLEWVATVSSGGTYTYYPDSVKGRFTISRDNAKNTLYLQMSSLKSEDSAMYYCARHRGNYYATYYYAMDYWGQGTSVTVSS

SEQ ID NO: 10 - protein, 243 aa, Artificial Sequence
  Synthesized
DVQITQSPSYLAASPGETITINCRASKSISKYLAWYQEKPGKTNKLLIYSGSTLQSGIPSRFSGSGSGTDFTLTISSLEPEDFAMYYCQQHHEYPYTFGGGTKLEIKGGGGSGGGGSGGGGSQVQLQQPGAELVRPGASVKLSCKASGYTFTTYWMNWVKQRPEQGLEWIGRIDPYDSETHYNQKFKDKAILTVDKSSSTAYMQLSSLTSEDSAVYYCARGPYYGTNPWFPYWGQGTLVTVSS

SEQ ID NO: 11 - protein, 241 aa, Artificial Sequence
  Synthesized
EIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSS

SEQ ID NO: 12 - protein, 246 aa, Artificial Sequence
  Synthesized
DVVMTQTPLSLPVRLGDQASISCRSSQSLVHSNGNTYLHWYLQKPGQSPKLLIYKVSNRFSGVPDRFSGSGSGTNFTLKISRVEAEDLGLYFCSQSTHVPYTFGGGTKLEIKRAGGGGSGGGGSGGGGSQVQLRQSGPELVKPGASVKMSCKASGYTFTDYVISWVKQRTGQGLEWIGDIYPGSGYSFYNENFKGKATLTADKSSTTAYMQLSSLTSEDSAVYFCATYYNYPFAYWGQGTLVTVSA

SEQ ID NO: 13 - protein, 199 aa, Artificial Sequence
  Synthesized
LPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 14 - protein, 240 aa, Artificial Sequence
  Synthesized
DIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIKGGGGGSGGGGSGGGGSDIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIK

SEQ ID NO: 15 - protein, 281 aa, Artificial Sequence
  Synthesized
MNVPTQLLGLLLLWLTGGKCDIQMTQSPASLSASLEEIVTITCKASQAIDAYLSWYQQKPGKSPQLLIYDATSLADGVPSRFSGSRSGTQYSLKISRPQVDDSGIYYCLQSYSTPFTFGSGTKLEIKGGGGGSGGGGSGGGGSMAVLVLLLCLLIFPSCVLSQVQLKESGPGLVQPSQTLSLTCTVSGSSLTSNSVSWIRQPPGKGLEWMGVIWSNGDADYNSAIKSRLSISRDTSKSQVFLKMNSLQTEDTAMYFCASPYYGYYFPFDYWGQGVMVTVSS

SEQ ID NO: 16 - protein, 285 aa, Artificial Sequence
  Synthesized
METDTLLLWVLLLWVPGSTGDIVLTQSPALAVSLGQRATISCRASQSVSISSHDLMQWYQQKPGQQPKLLIYDAFNLASGIPVRFSGSGSGTDFTLTIDPVQADDIATYYCQQSKDDPYTFGAGTKLELKGGGGGSGGGGSGGGGSMDIRLSLAFLVLFIKGVQCEVQLVESGGGLVQPGRSMKLSCAASGFTFSNYGMAWVRQAPTKGLEWVATISYDGSITYYRDSVKGRFTISRDHAKSTLYLQMNSLRSEDTATYYCTREEQYSSWYFDFWGPGIMVTVSS

SEQ ID NO: 17 - protein, 242 aa, Artificial Sequence
  Synthesized
NIVMTQSPSSLSASVGDRVTITCQASQDVGTAVAWYQQKPDQSPKLLIYWTSTRHTGVPDRFTGSGSGTDFTLTISSLQPEDIATYFCHQYNSYNTFGSGTKLEIKGGGGGSGGGGSGGGGSQVTLKESGPVLVKPTETLTLTCTFSGFSLSTSGMGVGWIRQAPGKGLEWVAHIWWDDDVYYNPSLKSRLTITKDASKDQVSLKLSSVTAADTAVYYCVRRRATGTGFDYWGQGTLVTVSS

SEQ ID NO: 18 - protein, 272 aa, Homo sapiens
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWK

SEQ ID NO: 19 - protein, 205 aa, Homo sapiens
ISSMDMERPGDGKCQPIEIPMCKDIGYNMTRMPNLMGHENQREAAIQLHEFAPLVEYGCHGHLRFFLCSLYAPMCTEQVSTPIPACRVMCEQARLKCSPIMEQFNFKWPDSLDCRKLPNKNDPNYLCMEAPNNGSDEPTRGSGLFPPLFRPQRPHSAQEHPLKDGGPGRGGCDNPGKFHHVEKSASCAPLCTPGVDVYWSREDKR

SEQ ID NO: 20 - protein, 393 aa, Homo sapiens
GMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMG

SEQ ID NO: 21 - protein, 210 aa, Homo sapiens
QLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMND

SEQ ID NO: 22 - protein, 4368 aa, Homo sapiens
EQDLSVNRAVWDGGGCISQGDVLNRQCQQLSQHVRTGSAANTATGTTSTNVVEPRMYLSCSTNPEMTSIESSVTSDTPGVSSTRMTPTESRTTSESTSDSTTLFPSSTEDTSSPTTPEGTDVPMSTPSEESISSTMAFVSTAPLPSFEAYTSLTYKVDMSTPLTTSTQASSSPTTPESTTIPKSTNSEGSTPLTSMPASTMKVASSEAITLLTTPVEISTPVTISAQASSSPTTAEGPSLSNSAPSGGSTPLTRMPLSVMLVVSSEASTLSTTPAATNIPVITSTEASSSPTTAEGTSIPTSTYTEGSTPLTSTPASTMPVATSEMSTLSITPVDTSTLVTTSTEPSSLPTTAEATSMLTSTLSEGSTPLTNMPVSTILVASSEASTTSTIPVDSKTFVTTASEASSSPTTAEDTSIATSTPSEGSTPLTSMPVSTTPVASSEASNLSTTPVDSKTQVTTSTEASSSPPTAEVNSMPTSTPSEGSTPLTSMSVSTMPVASSEASTLSTTPVDTSTPVTTSSEASSSSTTPEGTSIPTSTPSEGSTPLTNMPVSTRLVVSSEASTTSTTPADSNTFVTTSSEASSSSTTAEGTSMPTSTYSERGTTITSMSVSTTLVASSEASTLSTTPVDSNTPVTTSTEATSSSTTAEGTSMPTSTYTEGSTPLTSMPVNTTLVASSEASTLSTTPVDTSTPVTTSTEASSSPTTADGASMPTSTPSEGSTPLTSMPVSKTLLTSSEASTLSTTPLDTSTHITTSTEASCSPTTTEGTSMPISTPSEGSPLLTSIPVSITPVTSPEASTLSTTPVDSNSPVTTSTEVSSSPTPAEGTSMPTSTYSEGRTPLTSMPVSTTLVATSAISTLSTTPVDTSTPVTNSTEARSSPTTSEGTSMPTSTPGEGSTPLTSMPDSTTPVVSSEARTLSATPVDTSTPVTTSTEATSSPTTAEGTSIPTSTPSEGTTPLTSTPVSHTLVANSEASTLSTTPVDSNTPLTTSTEASSPPPTAEGTSMPTSTPSEGSTPLTRMPVSTTMVASSETSTLSTTPADTSTPVTTYSQASSSSTTADGTSMPTSTYSEGSTPLTSVPVSTRLVVSSEASTLSTTPVDTSIPVTTSTEASSSPTTAEGTSIPTSPPSEGTTPLASMPVSTTLVVSSEANTLSTTPVDSKTQVATSTEASSPPPTAEVTSMPTSTPGERSTPLTSMPVRHTPVASSEASTLSTSPVDTSTPVTTSAETSSSPTTAEGTSLPTSTTSEGSTLLTSIPVSTTLVTSPEASTLLTTPVDTKGPVVTSNEVSSSPTPAEGTSMPTSTYSEGRTPLTSIPVNTTLVASSAISILSTTPVDNSTPVTTSTEACSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPVDSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVSTMLVVSSEANTLSTTPIDSKTQVTASTEASSSTTAEGSSMTISTPSEGSPLLTSIPVSTTPVASPEASTLSTTPVDSNSPVITSTEVSSSPTPAEGTSMPTSTYTEGRTPLTSITVRTTPVASSAISTLSTTPVDNSTPVTTSTEARSSPTTSEGTSMPNSTPSEGTTPLTSIPVSTTPVLSSEASTLSATPIDTSTPVTTSTEATSSPTTAEGTSIPTSTLSEGMTPLTSTPVSHTLVANSEASTLSTTPVDSNSPVVTSTAVSSSPTPAEGTSIATSTPSEGSTALTSIPVSTTTVASSETNTLSTTPAVTSTPVTTYAQVSSSPTTADGSSMPTSTPREGRPPLTSIPVSTTTVASSEINTLSTTLADTRTPVTTYSQASSSPTTADGTSMPTPAYSEGSTPLTSMPLSTTLVVSSEASTLSTTPVDTSTPATTSTEGSSSPTTAGGTSIQTSTPSERTTPLAGMPVSTTLVVSSEGNTLSTTPVDSKTQVTNSTEASSSATAEGSSMTISAPSEGSPLLTSIPLSTTPVASPEASTLSTTPVDSNSPVITSTEVSSSPIPTEGTSMQTSTYSDRRTPLTSMPVSTTVVASSAISTLSTTPVDTSTPVTNSTEARSSPTTSEGTSMPTSTPSEGSTPFTSMPVSTMPVVTSEASTLSATPVDTSTPVTTSTEATSSPTTAEGTSIPTSTLSEGTTPLTSIPVSHTLVANSEVSTLSTTPVDSNTPFTTSTEASSPPPTAEGTSMPTSTSSEGNTPLTRMPVSTTMVASFETSTLSTTPADTSTPVTTYSQAGSSPTTADDTSMPTSTYSEGSTPLTSVPVSTMPVVSSEASTHSTTPVDTSTPVTTSTEASSSPTTAEGTSIPTSPPSEGTTPLASMPVSTTPVVSSEAGTLSTTPVDTSTPMTTSTEASSSPTTAEDIVVPISTASEGSTLLTSIPVSTTPVASPEASTLSTTPVDSNSPVVTSTEISSSATSAEGTSMPTSTYSEGSTPLRSMPVSTKPLASSEASTLSTTPVDTSIPVTTSTETSSSPTTAKDTSMPISTPSEVSTSLTSILVSTMPVASSEASTLSTTPVDTRTLVTTSTGTSSSPTTAEGSSMPTSTPGERSTPLTNILVSTTLLANSEASTLSTTPVDTSTPVTTSAEASSSPTTAEGTSMRISTPSDGSTPLTSILVSTLPVASSEASTVSTTAVDTSIPVTTSTEASSSPTTAEVTSMPTSTPSETSTPLTSMPVNHTPVASSEAGTLSTTPVDTSTPVTTSTKASSSPTTAEGIVVPISTASEGSTLLTSIPVSTTPVASSEASTLSTTPVDTSIPVTTSTEGSSSPTTAEGTSMPISTPSEVSTPLTSILVSTVPVAGSEASTLSTTPVDTRTPVTTSAEASSSPTTAEGTSMPISTPGERRTPLTSMSVSTMPVASSEASTLSRTPADTSTPVTTSTEASSSPTTAEGTGIPISTPSEGSTPLTSIPVSTTPVAIPEASTLSTTPVDSNSPVVTSTEVSSSPTPAEGTSMPISTYSEGSTPLTGVPVSTTPVTSSAISTLSTTPVDTSTPVTTSTEAHSSPTTSEGTSMPTSTPSEGSTPLTYMPVSTMLVVSSEDSTLSATPVDTSTPVTTSTEATSSTTAEGTSIPTSTPSEGMTPLTSVPVSNTPVASSEASILSTTPVDSNTPLTTSTEASSSPPTAEGTSMPTSTPSEGSTPLTSMPVSTTTVASSETSTLSTTPADTSTPVTTYSQASSSPPIADGTSMPTSTYSEGSTPLTNMSFSTTPVVSSEASTLSTTPVDTSTPVTTSTEASLSPTTAEGTSIPTSSPSEGTTPLASMPVSTTPVVSSEVNTLSTTPVDSNTLVTTSTEASSSPTIAEGTSLPTSTTSEGSTPLSIMPLSTTPVASSEASTLSTTPVDTSTPVTTSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSLVYG

SEQ ID NO: 23 - protein, 407 aa, Homo sapiens
SQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQ

SEQ ID NO: 24 - protein, 264 aa, Homo sapiens
PRFMGTISDVKTNVQLLKGRVDNISTLDSEIKKNSDGMEAAGVQIQMVNESLGYVRSQFLKLKTSVEKANAQIQILTRSWEEVSTLNAQIPELKSDLEKASALNTKIRALQGSLENMSKLLKRQNDILQVVSQGWKYFKGNFYYFSLIPKTWYSAEQFCVSRNSHLTSVTSESEQEFLYKTAGGLIYWIGLTKAGMEGDWSWVDDTPFNKVQSVRFWIPGEPNNAGNNEHCGNIKAPSLQAWNDAPCDKTFLFICKRPYVPSEP

SEQ ID NO: 25 - protein, 100 aa, Homo sapiens
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENC

SEQ ID NO: 26 - protein, 371 aa, Homo sapiens
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 27 - protein, 348 aa, Homo sapiens
RLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNP

SEQ ID NO: 28 - DNA, 7902 bp, Artificial Sequence
  Synthesized
gtcgacactagtaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgccgcggaattcgagctcggtacctttaagaccaatgacttacaaggcagctgtagatcttagccactttttaaaagaaaaggggggactggaagggctaattcactcccaacgaagacaagatctgctttttgcttgtactgagtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacggctctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgatcacgagactagcctcgacacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagaaatccactttggctcgagaagcttgatatcggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcc

SEQ ID NO: 29 - protein, 66 aa, Artificial Sequence
  Synthesized
TTTPAPRPPTPAPTIASQPLSLRPEACRPAAGGAVHTRGLDFACDIYIWAPLAGTCGVLLLSLVIT

SEQ ID NO: 30 - protein, 69 aa, Artificial Sequence
  Synthesized
TTTPAPRPPTPAPTIASQPLSLRPEACRPAAGGAVHTRGLDFACDIYIWAPLAGTCGVLLLSLVITLYC

SEQ ID NO: 31 - protein, 72 aa, Artificial Sequence
  Synthesized
AKPTTTPAPRPPTPAPTIASQPLSLRPEACRPAAGGAVHTRGLDFACDIYIWAPLAGTCGVLLLSLVITLYC

SEQ ID NO: 32 - protein, 69 aa, Artificial Sequence; identical to SEQ ID NO: 2
  Synthesized

SEQ ID NO: 33 - protein, 50 aa, Artificial Sequence
  Synthesized
AKPTTTPAPRPPTPAPTIASQPLSLRPEACRPAAGGAVHTRGLDFACDIY

SEQ ID NO: 34 - protein, 50 aa, Artificial Sequence; identical to SEQ ID NO: 33
  Synthesized

SEQ ID NO: 35 - protein, 47 aa, Artificial Sequence
  Synthesized
TTTPAPRPPTPAPTIASQPLSLRPEACRPAAGGAVHTRGLDFACDIY

SEQ ID NO: 36 - protein, 47 aa, Artificial Sequence; identical to SEQ ID NO: 35
  Synthesized

SEQ ID NO: 37 - protein, 22 aa, Artificial Sequence
  Synthesized
IWAPLAGTCGVLLLSLVITLYC

SEQ ID NO: 38 - protein, 22 aa, Artificial Sequence
  Synthesized
IWAPLAGTCGVLLLSLVITLYC

SEQ ID NO: 39 - protein, 270 aa, Artificial Sequence
  Synthesized
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGG

SEQ ID NO: 40 - protein, 19 aa, Artificial Sequence
  Synthesized
IWAPLAGTCGVLLLSLVIT

SEQ ID NO: 41 - DNA, 339 bp, Artificial Sequence
  Synthesized
agagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 42 - DNA, 1689 bp, Artificial Sequence
  Synthesized
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 43 - DNA, 1689 bp, Homo sapiens
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 44 - DNA, 1689 bp, Artificial Sequence; identical to SEQ ID NO: 42
  Synthesized

SEQ ID NO: 45 - DNA, 1689 bp, Artificial Sequence; identical to SEQ ID NO: 43
  Synthesized

SEQ ID NO: 46 - protein, 106 aa, Artificial Sequence
  Synthesized
NIVMTQSPSSLSASVGDRVTITCQASQDVGTAVAWYQQKPDQSPKLLIYWTSTRHTGVPDRFTGSGSGTDFTLTISSLQPEDIATYFCHQYNSYNTFGSGTKLEIK

SEQ ID NO: 47 - protein, 120 aa, Artificial Sequence
  Synthesized
QVTLKESGPVLVKPTETLTLTCTFSGFSLSTSGMGVGWIRQAPGKGLEWVAHIWWDDDVYYNPSLKSRLTITKDASKDQVSLKLSSVTAADTAVYYCVRRRATGTGFDYWGQGTLVTVSS

SEQ ID NO: 48 - protein, 130 aa, Artificial Sequence
  Synthesized
METDTLLLWVLLLWVPGSTGDIVLTQSPALAVSLGQRATISCRASQSVSISSHDLMQWYQQKPGQQPKLLIYDAFNLASGIPVRFSGSGSGTDFTLTIDPVQADDIATYYCQQSKDDPYTFGAGTKLELK

SEQ ID NO: 49 - protein, 139 aa, Artificial Sequence
  Synthesized
MDIRLSLAFLVLFIKGVQCEVQLVESGGGLVQPGRSMKLSCAASGFTFSNYGMAWVRQAPTKGLEWVATISYDGSITYYRDSVKGRFTISRDHAKSTLYLQMNSLRSEDTATYYCTREEQYSSWYFDFWGPGIMVTVSS

SEQ ID NO: 50 - protein, 112 aa, Artificial Sequence
  Synthesized
DIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIK

SEQ ID NO: 51 - protein, 119 aa, Artificial Sequence
  Synthesized
EVQLVQSGAEVKKPGASVKVSCKASGYTFTNYYIHWVRQAPGQGLEWIGWIYPGDGNTKYNEKFKGRATLTADTSTSTAYLELSSLRSEDTAVYYCARDSYSNYYFDYWGQGTLVTVSS

SEQ ID NO: 52 - protein, 413 aa, Artificial Sequence
  Synthesized
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMG

SEQ ID NO: 53 - protein, 115 aa, Artificial Sequence
  Synthesized
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSS

SEQ ID NO: 54 - protein, 108 aa, Artificial Sequence
  Synthesized
EIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIK

SEQ ID NO: 55 - protein, 140 aa, Artificial Sequence
  Synthesized
MGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAA

SEQ ID NO: 56 - protein, 131 aa, Artificial Sequence
  Synthesized
MGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIR

SEQ ID NO: 57 - protein, 120 aa, Artificial Sequence
  Synthesized
QVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSS

SEQ ID NO: 58 - protein, 111 aa, Artificial Sequence
  Synthesized
EIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIK

SEQ ID NO: 59 - DNA, 1473 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 60 - DNA, 1446 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 61 - DNA, 1467 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 62 - DNA, 3533 bp, Artificial Sequence
  Synthesized
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 63 - DNA, 3533 bp, Artificial Sequence
  Synthesized
atggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 64 - DNA, 3545 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 65 - DNA, 3518 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 66 - DNA, 2994 bp, Artificial Sequence
  Synthesized
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 67 - DNA, 2994 bp, Artificial Sequence
  Synthesized
atggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 68 - DNA, 3009 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 69 - DNA, 2982 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 70 - protein, 244 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 71 - protein, 116 aa, Artificial Sequence
  Synthesized
QVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 72 - protein, 113 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELK

SEQ ID NO: 73 - protein, 12 aa, Artificial Sequence
  Synthesized
QSLLNSGDQKNY

SEQ ID NO: 74 - protein, 107 aa, Artificial Sequence
  Synthesized
DIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIK

SEQ ID NO: 75 - protein, 9 aa, Artificial Sequence
  Synthesized
QNDYSYPLT

SEQ ID NO: 76 - protein, 8 aa, Artificial Sequence
  Synthesized
GYTFTDHA

SEQ ID NO: 77 - protein, 8 aa, Artificial Sequence
  Synthesized
FSPGNTDI

SEQ ID NO: 78 - protein, 9 aa, Artificial Sequence
  Synthesized
KTSTFFFDY

SEQ ID NO: 79 - protein, 246 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 80 - protein, 117 aa, Artificial Sequence
  Synthesized
EVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 81 - protein, 114 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRA

SEQ ID NO: 82 - protein, 16 aa, Artificial Sequence
  Synthesized
RSSKSLLHSNGITYFF

SEQ ID NO: 83 - protein, 7 aa, Artificial Sequence
  Synthesized
QMSNLAS

SEQ ID NO: 84 - protein, 9 aa, Artificial Sequence
  Synthesized
AQNLELPPT

SEQ ID NO: 85 - protein, 5 aa, Artificial Sequence
  Synthesized
NYWMN

SEQ ID NO: 86 - protein, 19 aa, Artificial Sequence
  Synthesized
EIRLKSNNYTTHYAESVKG

SEQ ID NO: 87 - protein, 6 aa, Artificial Sequence
  Synthesized
HYYFDY

SEQ ID NO: 88 - protein, 4 aa, Artificial Sequence
  Synthesized
GSTA

SEQ ID NO: 89 - protein, 97 aa, Artificial Sequence
  Synthesized
CSRAARGTIGARRTGQPLKEDPSAVPVFSVDAGELDFQWREKTPEPPVPCVPEQTEAATIVFPSGMGTSSPARRGSADGPRSAQPLRPEDGHCSWPL

SEQ ID NO: 90 - protein, 17 aa, Artificial Sequence
  Synthesized
CSRAARGTIDGHCSWPL

SEQ ID NO: 91 - protein, 21 aa, Artificial Sequence
  Synthesized
VGVVGGLLGSLVLLVWVLAVI

SEQ ID NO: 92 - protein, 18 aa, Artificial Sequence
  Synthesized
GNILNVSIKICLTLSPST

SEQ ID NO: 93 - protein, 9 aa, Artificial Sequence
  Synthesized
CSRAARGTI

SEQ ID NO: 94 - protein, 80 aa, Artificial Sequence
  Synthesized
GARRTGQPLKEDPSAVPVFSVDYGELDFQWREKTPEPPVPCVPEQTEYATIVFPSGMGTSSPARRGSADGPRSAQPLRPE

SEQ ID NO: 95 - protein, 80 aa, Artificial Sequence; identical to SEQ ID NO: 94
  Synthesized

SEQ ID NO: 96 - protein, 196 aa, Artificial Sequence
  Synthesized
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 97 - protein, 196 aa, Artificial Sequence
  Synthesized
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVKENQTRNKHINPNEWWKVYPSSVTEFKFLFVSGHFKGNYKAQLTRLNHKTNCNGAVLSVEELLIGGEMIKAGTLTLEEVRRKFNNGEINF

SEQ ID NO: 98 - protein, 196 aa, Artificial Sequence
  Synthesized
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMERYVEENQTRNKHLNPNEWWKVYPSSVTEFKFLFVSGHFKGNYKAQLTRLNHITNCNGAVLSVEELLIGGEMIKAGTLTLEEVRRKFNNGEINF

SEQ ID NO: 99 - protein, 323 aa, Artificial Sequence [sequence omitted]

SEQ ID NO: 100 - protein, 127 aa, Artificial Sequence
  Synthesized
MNVPTQLLGLLLLWLTGGKCDIQMTQSPASLSASLEEIVTITCKASQAIDAYLSWYQQKPGKSPQLLIYDATSLADGVPSRFSGSRSGTQYSLKISRPQVDDSGIYYCLQSYSTPFTFGSGTKLEIK

SEQ ID NO: 101 - protein, 184 aa, Homo sapiens
MAPLLPIRTLPLILILLALLSPGAADFNISSLSGLLSPALTESLLVALPPCHLTGGNATLMVRRANDSKVVTSSFVVPPCRGRRELVSVVDSGAGFTVTRLSAYQVTNLVPGTKFYISYLVKKGTATESSREIPMSTLPRRNMESIGLGMARTGGMVVITVLLSVAMFLLVLGFIIALALGSRK

SEQ ID NO: 102 - protein, 909 aa, Homo sapiens
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 103 - protein, 553 aa, Homo sapiens
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 104 - protein, 418 aa, Homo sapiens
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQVLKVIFAVAFCLISAVLMVLLFIHIRRGLCWQRESYGNI

SEQ ID NO: 105 - protein, 560 aa, Homo sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTVSSGISIATNSESSTTSSGASTATNSESSTPSSGASTATNSDSSTTSSGASTATNSDSSTTSSEASTATNSESSTTSSGASTATNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMS

SEQ ID NO: 106 - protein, 14507 aa, Homo sapiens
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTYTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWTSVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGSSPAGTSPGSPEMSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLRTLNTLDINLESGTTSSPSWKSSPYERIAPSESTTDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVSWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPEPVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAVANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSLAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHEILTTDEDTTAIEAMHPSTSTAATNVETTSSGHGSQSSVLADSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSSGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSLLTPGQVKTTEVLDASAEPETSSPPSLSSTSVEILATSEVTTDTEKIHPFSNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLDTSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLNPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSTLPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISTEVITRLSTSPIKTESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILAITEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRIHIPDSDQSTMSPDIITEVITRLSSSSMMSESTQMTITTQKSSPGATAQSTLTLATTTAPLARTHSTVPPRFLHSEMTTLMSRSPENPSWKSSLFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSSPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASMQMASTIPTEMMITTPYVFPDVPETTSSLATSLGAETSTALPRTTPSVFNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSATAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTTGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMRRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPMTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGVITCLICGVLVTTRRRKKEGEYNVQQQCPGYYQSHLDLEDLQ

SEQ ID NO: 107 - protein, 267 aa, Homo sapiens
MMSSKPTSHAEVNETIPNPYPPSSFMAPGFQQPLGSINLENQAQGAQRAQPYGITSPGIFASSQPGQGNIQMINPSVGTAVMNFKEEAKALGVIQIMVGLMHIGFGIVLCLISFSFREVLGFASTAVIGGYPFWGGLSFIISGSLSVSASKELSRCLVKGSLGMNIVSSILAFIGVILLLVDMCINGVAGQDYWAVLSGKGISATLMIFSLLEFFVACATAHFANQANTTTNMSVLVIPNMYESNPVTPASSSAPPRCNNYSANAPK

SEQ ID NO: 108 - protein, 535 aa, Homo sapiens
MLGPCMLLLLLLLGLRLQLSLGIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 109 - protein, 520 aa, Homo sapiens
MEFHNGGHVSGIGGFLVSLTSRMKPHTLAVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 110 - protein, 221 aa, Homo sapiens
MLTLEDKDMKGFSWAIVPALTSLGYLIILVVSIFPFWVRLTNEESHEVFFSGLFENCFNAKCWKPRPLSIYIILGRVFLLSAVFLAFVTTFIMMPFASEFFPRTWKQNFVLACISFFTGACAFLALVLHALEIKALRMKLGPLQFSVLWPYYVLGFGIFLFIVAGTICLIQEMVCPCWHLLSTSQSMEEDHGSLYLDNLESLGGEPSSVQKETQVTAETVI

SEQ ID NO: 111 - protein, 538 aa, Homo sapiens
MGLLLLVLILTPSLAAYRHPDFPLLEKAQQLLQSTGSPYSTNCWLCTSSSTETPGTAYPASPREWTSIEAELHISYRWDPNLKGLMRPANSLLSTVKQDFPDIRQKPPIFGPIFTNINLMGIAPICVMAKRKNGTNVGTLPSTVCNVTFTVDSNQQTYQTYTHNQFRHQPRFPKPPNITFPQGTLLDKSSRFCQGRPSSCSTRNFWFRPADYNQCLQISNLSSTAEWVLLDQTRNSLFWENKTKGANQSQTPCVQVLAGMTIATSYLGISAVSEFFGTSLTPLFHFHISTCLKTQGAFYICGQSIHQCLPSNWTGTCTIGYVTPDIFIAPGNLSLPIPIYGNSPLPRVRRAIHFIPLLAGLGILAGTGTGIAGITKASLTYSQLSKEIANNIDTMAKALTTMQEQIDSLAAVVLQNRRGLDMLTAAQGGICLALDEKCCFWVNQSGKVQDNIRQLLNQASSLRERATQGWLNWEGTWKWFSWVLPLTGPLVSLLLLLLFGPCLLNLITQFVSSRLQAIKLQTNLSAGRHPRNIQESPF

SEQ ID NO: 112 - protein, 1017 aa, Homo sapiens
MVFSVRQCGHVGRTEEVLLTFKIFLVIICLHVVLVTSLEEDTDNSSLSPPPAKLSVVSFAPSSNGTPEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 113 - protein, 775 aa, Homo sapiens
MEPPYSLTAHYDEFQEVKYVSRCGAGGARGASLPPGFPLGAARSATGARSGLPRWNRREVCLLSGLVFAAGLCAILAAMLALKYLGPVAAGGGACPEGCPERKAFARAARFLAANLDASIDPCQDFYSFACGGWLRRHAIPDDKLTYGTIAAIGEQNEERLRRLLARPGGGPGGAAQRKVRAFFRSCLDMREIERLGPRPMLEVIEDCGGWDLGGAEERPGVAARWDLNRLLYKAQGVYSAAALFSLTVSLDDRNSSRYVIRIDQDGLTLPERTLYLAQDEDSEKILAAYRVFMERVLSLLGADAVEQKAQEILQVEQQLANITVSEHDDLRRDVSSMYNKVTLGQLQKITPHLRWKWLLDQIFQEDFSEEEEVVLLATDYMQQVSQLIRSTPHRVLHNYLVWRVVVVLSEHLSPPFREALHELAQEMEGSDKPQELARVCLGQANRHFGMALGALFVHEHFSAASKAKVQQLVEDIKYILGQRLEELDWMDAETRAAARAKLQYMMVMVGYPDFLLKPDAVDKEYEFEVHEKTYFKNILNSIRFSIQLSVKKIRQEVDKSTWLLPPQALNAYYLPNKNQMVFPAGILQPTLYDPDFPQSLNYGGIGTIIGHELTHGYDDWGGQYDRSGNLLHWWTEASYSRFLRKAECIVRLYDNFTVYNQRVNGKHTLGENIADMGGLKLAYHAYQKWVREHGPEHPLPRLKYTHDQLFFIAFAQNWCIKRRSQSIYLQVLTDKHAPEHYRVLGSVSQFEEFGRAFHCPKDSPMNPAHKCSVW

SEQ ID NO: 114 - protein, 529 aa, Homo sapiens
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPTDFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 115 - protein, 537 aa, Homo sapiens
MPHLMERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTVPRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 116 - protein, 426 aa, Homo sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 117 - protein, 328 aa, Homo sapiens
MEKSIWLLACLAWVLPTGSFVRTKIDTTENLLNTEVHSSPAQRWSMQVPPEVSAEAGDAAVLPCTFTHPHRHYDGPLTAIWRAGEPYAGPQVFRCAAARGSELCQTALSLHGRFRLLGNPRRNDLSLRVERLALADDRRYFCRVEFAGDVHDRYESRHGVRLHVTAAPRIVNISVLPSPAHAFRALCTAEGEPPPALAWSGPALGNSLAAVRSPREGHGHLVTAELPALTHDGRYTCTAANSLGRSEASVYLFRFHGASGASTVALLLGALGFKALLLLGVLAARAARRRPEHLDTPDTPPRSQAQESNYENLSQMNPRSPPATMCSP

SEQ ID NO: 118 - protein, 620 aa, Homo sapiens
MSKSKCSVGLMSSVVAPAKEPNAVGPKEVELILVKEQNGVQLTSSTLTNPRQSPVEAQDRETWGKKIDFLLSVIGFAVDLANVWRFPYLCYKNGGGAFLVPYLLFMVIAGMPLFYMELALGQFNREGAAGVWKICPILKGVGFTVILISLYVGFFYNVIIAWALHYLFSSFTTELPWIHCNNSWNSPNCSDAHPGDSSGDSSGLNDTFGTTPAAEYFERGVLHLHQSHGIDDLGPPRWQLTACLVLVIVLLYFSLWKGVKTSGKVVWITATMPYVVLTALLLRGVTLPGAIDGIRAYLSVDFYRLCEASVWIDAATQVCFSLGVGFGVLIAFSSYNKFTNNCYRDAIVTTSINSLTSFSSGFVVFSFLGYMAQKHSVPIGDVAKDGPGLIFIIYPEAIATLPLSSAWAVVFFIMLLTLGIDSAMGGMESVITGLIDEFQLLHRHRELFTLFIVLATFLLSLFCVTNGGIYVFTLLDHFAAGTSILFGVLIEAIGVAWFYGVGQFSDDIQQMTGQRPSLYWRLCWKLVSPCFLLFVVVVSIVTFRPPHYGAYIFPDWANALGWVIATSSMAMVPIYAAYKFCSLPGSFREKLAYAIAPEKDRELVDRGEVRQFTLRHWLKV

SEQ ID NO: 119 - protein, 398 aa, Homo sapiens
MHTVATSGPNASWGAPANASGCPGCGANASDGPVPSPRAVDAWLVPLFFAALMLLGLVGNSLVIYVICRHKPMRTVTNFYIANLAATDVTFLLCCVPFTALLYPLPGWVLGDFMCKFVNYIQQVSVQATCATLTAMSVDRWYVTVFPLRALHRRTPRLALAVSLSIWVGSAAVSAPVLALHRLSPGPRAYCSEAFPSRALERAFALYNLLALYLLPLLATCACYAAMLRHLGRVAVRPAPADSALQGQVLAERAGAVRAKVSRLVAAVVLLFAACWGPIQLFLVLQALGPAGSWHPRSYAAYALKTWAHCMSYSNSALNPLLYAFLGSHFRQAFRRVCPCAPRRPRRPRRPGPSDPAAPHAELLRLGSHPAPARAQKPGSSGLAARGLCVLGEDNAPL

SEQ ID NO: 120 - protein, 431 aa, Homo sapiens
MQALNITPEQFSRLLRDHNLTREQFIALYRLRPLVYTPELPGRAKLALVLTGVLIFALALFGNALVFYVVTRSKAMRTVTNIFICSLALSDLLITFFCIPVTMLQNISDNWLGGAFICKMVPFVQSTAVVTEILTMTCIAVERHQGLVHPFKMKWQYTNRRAFTMLGVVWLVAVIVGSPMWHVQQLEIKYDFLYEKEHICCLEEWTSPVHQKIYTTFILVILFLLPLMVMLILYSKIGYELWIKKRVGDGSVLRTIHGKEMSKIARKKKRAVIMMVTVVALFAVCWAPFHVVHMMIEYSNFEKEYDDVTIKMIFAIVQIIGFSNSICNPIVYAFMNENFKKNVLSAVCYCIVNKTFSPAQRHGNSGITMMRKKAKFSLRENPVEETKGEAFSDGNIEVKLCEQTEEKKKLKRHLALFRSELAENSPLDSGH

SEQ ID NO: 121 - protein, 335 aa, Homo sapiens
MESSFSFGVILAVLASLIIATNTLVAVAVLLLIHKNDGVSLCFTLNLAVADTLIGVAISGLLTDQLSSPSRPTQKTLCSLRMAFVTSSAAASVLTVMLITFDRYLAIKQPFRYLKIMSGFVAGACIAGLWLVSYLIGFLPLGIPMFQQTAYKGQCSFFAVFHPHFVLTLSCVGFFPAMLLFVFFYCDMLKIASMHSQQIRKMEHAGAMAGGYRSPRTPSDFKALRTVSVLIGSFALSWTPFLITGIVQVACQECHLYLVLERYLWLLGVGNSLLNPLIYAYWQKEVRLQLYHMALGVKKVLTSFLLFLSARNCGPERPRESSCHIVTISSSEFDG

SEQ ID NO: 122 - protein, 220 aa, Homo sapiens
MASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAIIRDFYNPLVAEAQKRELGASLYLGWAASGLLLLGGGLLCCTCPSGGSQGPSHYMARYSTSAPAISRGPSEYPTKNYV

SEQ ID NO: 123 - protein, 21 aa, Homo sapiens
MALPVTALLLPLALLLHAARP

SEQ ID NO: 124 - protein, 15 aa, Homo sapiens
GGGGSGGGGSGGGGS

SEQ ID NO: 125 - protein, 45 aa, Artificial Sequence
  Synthesized
TTTPAPRPPTPAPTIASQPLSLRPEACRPAAGGAVHTRGLDFACD

SEQ ID NO: 126 - protein, 23 aa, Artificial Sequence
  Synthesized
YIWAPLAGTCGVLLLSLVITLYC

SEQ ID NO: 127 - protein, 42 aa, Artificial Sequence; identical to SEQ ID NO: 3
  Synthesized

SEQ ID NO: 128 - protein, 112 aa, Artificial Sequence; identical to SEQ ID NO: 4
  Synthesized

SEQ ID NO: 129 - protein, 485 aa, Artificial Sequence
  Synthesized
MALPVTALLLPLALLLHAARPQIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIKGGGGSGGGGSGGGGSEVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 130 - protein, 241 aa, Artificial Sequence
  Synthesized
QIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIKGGGGSGGGGSGGGGSEVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSA

SEQ ID NO: 131 - protein, 108 aa, Artificial Sequence
  Synthesized
QIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIK

SEQ ID NO: 132 - protein, 118 aa, Artificial Sequence
  Synthesized
EVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSA

SEQ ID NO: 133 - protein, 488 aa, Artificial Sequence
  Synthesized
MALPVTALLLPLALLLHAARPENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 134 - protein, 244 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSS

SEQ ID NO: 135 - protein, 106 aa, Artificial Sequence
  Synthesized
NVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKE

SEQ ID NO: 136 - protein, 123 aa, Artificial Sequence
  Synthesized
EVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSS

SEQ ID NO: 137 - protein, 485 aa, Artificial Sequence
  Synthesized
MALPVTALLLPLALLLHAARPDIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKGGGGSGGGGSGGGGSEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVSTTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 138 - protein, 241 aa, Artificial Sequence
  Synthesized
DIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKGGGGSGGGGSGGGGSEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVST

SEQ ID NO: 139 - protein, 107 aa, Artificial Sequence
  Synthesized
DIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIK

SEQ ID NO: 140 - protein, 119 aa, Artificial Sequence
  Synthesized
EVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVST

SEQ ID NO: 141 - protein, 488 aa, Artificial Sequence
  Synthesized
MALPVTALLLPLALLLHAARPENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 142 - protein, 244 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSS

SEQ ID NO: 143 - protein, 106 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELK

SEQ ID NO: 144 - protein, 123 aa, Artificial Sequence
  Synthesized
EVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSS

SEQ ID NO: 145 - protein, 482 aa, Artificial Sequence
  Synthesized
MALPVTALLLPLALLLHAARPSSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLGGGGGSGGGGSGGGGSQLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 146 - protein, 238 aa, Artificial Sequence
  Synthesized
SSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLGGGGGSGGGGSGGGGSQLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTV

SEQ ID NO: 147 - protein, 109 aa, Artificial Sequence
  Synthesized
SSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLG

SEQ ID NO: 148 - protein, 114 aa, Artificial Sequence
  Synthesized
QLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTV

SEQ ID NO: 149 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 150 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 151 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 152 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 153 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 154 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 155 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 156 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 157 - protein, 112 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIK

SEQ ID NO: 158 - protein, 112 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIK

SEQ ID NO: 159 - protein, 123 aa, Artificial Sequence
  Synthesized
EIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 160 - protein, 123 aa, Artificial Sequence
  Synthesized
EIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 161 - protein, 123 aa, Artificial Sequence
  Synthesized
EIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 162 - protein, 123 aa, Artificial Sequence
  Synthesized
EIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 163 - protein, 482 aa, Artificial Sequence
  Synthesized
MALPVTALLLPLALLLHAARPDIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIKGGGGSGGGGSGGGGSEVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 164 - protein, 238 aa, Artificial Sequence
  Synthesized
DIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIKGGGGSGGGGSGGGGSEVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSS

SEQ ID NO: 165 - protein, 107 aa, Artificial Sequence
  Synthesized
DIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIK

SEQ ID NO: 166 - protein, 116 aa, Artificial Sequence
  Synthesized
EVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSS

SEQ ID NO: 167 - protein, 482 aa, Artificial Sequence
  Synthesized
MALPVTALLLPLALLLHAARPDIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIKGGGGSGGGGSGGGGSDVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 168 - protein, 238 aa, Artificial Sequence
  Synthesized
DIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIKGGGGSGGGGSGGGGSDVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSA

SEQ ID NO: 169 - protein, 107 aa, Artificial Sequence
  Synthesized
DIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIK

SEQ ID NO: 170 - protein, 116 aa, Artificial Sequence
  Synthesized
DVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSA

SEQ ID NO: 171 - protein, 298 aa, Artificial Sequence
  Synthesized
MALPVTALLLPLALLLHAARPGTSLSPPPESSGSPQQPGLSAPHSRQIPAPQGAVLVQREKDLPNYNWNSFGLRFTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 172 - protein, 54 aa, Artificial Sequence
  Synthesized
GTSLSPPPESSGSPQQPGLSAPHSRQIPAPQGAVLVQREKDLPNYNWNSFGLRF

SEQ ID NO: 173 - protein, 19 aa, Artificial Sequence
  Synthesized
GTTGCTCCAGGCCACAGCA

SEQ ID NO: 174 - protein, 7 aa, Artificial Sequence
  Synthesized
QSGDLTR

SEQ ID NO: 175 - protein, 7 aa, Artificial Sequence
  Synthesized
QWGTRYR

SEQ ID NO: 176 - protein, 7 aa, Artificial Sequence
  Synthesized
ERGTLAR

SEQ ID NO: 177 - protein, 7 aa, Artificial Sequence
  Synthesized
RSDNLRE

SEQ ID NO: 178 - protein, 7 aa, Artificial Sequence
  Synthesized
QSGDLTR

SEQ ID NO: 179 - protein, 7 aa, Artificial Sequence
  Synthesized
TSGALTR

SEQ ID NO: 180 - protein, 12 aa, Artificial Sequence
  Synthesized
GACTTTGCATGT

SEQ ID NO: 181 - protein, 7 aa, Artificial Sequence
  Synthesized
WRSSLAS

SEQ ID NO: 182 - protein, 7 aa, Artificial Sequence
  Synthesized
QSGSLTR

SEQ ID NO: 183 - protein, 7 aa, Artificial Sequence
  Synthesized
HKWVLRQ

SEQ ID NO: 184 - protein, 7 aa, Artificial Sequence
  Synthesized
DRSNLTR

SEQ ID NO: 185 - protein, 293 aa, Artificial Sequence
  Synthesized
MQRISSLIHLSLFWAGVMSAIELVPEHQTVPVSIGVPATLRCSMKGEAIGNYYINWYRKTQGNTITFIYREKDIYGPGFKDNFQGDIDIAKNLAVLKILAPSERDEGSYYCACDTMGHPRGKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLTRDC

SEQ ID NO: 186 - protein, 315 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEAQQELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 187 - protein, 292 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTLGMGGEYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 188 - protein, 313 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEWELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 189 - protein, 288 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTLVSTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 190 - protein, 314 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEVGELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 191 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTVAHGGGTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 192 - protein, 313 aa, Artificial Sequence; identical to SEQ ID NO: 188
  Synthesized

SEQ ID NO: 193 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDNLSTGGYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 194 - protein, 316 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEVYQGELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 195 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDILGEKPYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 196 - DNA, 339 bp, Artificial Sequence; identical to SEQ ID NO: 41
  Synthesized

SEQ ID NO: 197 - protein, 276 aa, Artificial Sequence
  Synthesized
MKKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSDRGSTLGRLYFGRGTQLTVWPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 198 - protein, 313 aa, Artificial Sequence
  Synthesized
MTIRLLCYVGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSGLRDRGLYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 199 - protein, 267 aa, Artificial Sequence
  Synthesized
MWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVKDSNYQLIWGAGTKLIIKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 200 - protein, 138 aa, Artificial Sequence
  Synthesized
MAVLVLLLCLLIFPSCVLSQVQLKESGPGLVQPSQTLSLTCTVSGSSLTSNSVSWIRQPPGKGLEWMGVIWSNGDADYNSAIKSRLSISRDTSKSQVFLKMNSLQTEDTAMYFCASPYYGYYFPFDYWGQGVMVTVSS

SEQ ID NO: 201 - DNA, 3533 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 202 - protein, 488 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 203 - protein, 486 aa, Artificial Sequence
  Synthesized
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 204 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 205 - protein, 485 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 206 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 207 - protein, 483 aa, Artificial Sequence
  Synthesized
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 208 - DNA, 3515 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 209 - DNA, 3533 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 210 - protein, 490 aa, Artificial Sequence
  Synthesized
MALPVTALLLPLALLLHAARPDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 211 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 212 - protein, 487 aa, Artificial Sequence
  Synthesized
MALPVTALLLPLALLLHAARPDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 213 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 214 - DNA, 3515 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 215 - DNA, 3533 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 216 - protein, 486 aa, Artificial Sequence
  Synthesized
MALPVTALLLPLALLLHAARPDIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 217 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 218 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 219 - protein, 483 aa, Artificial Sequence
  Synthesized
MALPVTALLLPLALLLHAARPDIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 220 - DNA, 3515 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 221 - DNA, 3533 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 222 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 223 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 224 - DNA, 3515 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 225 - DNA, 3545 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 226 - protein, 490 aa, Artificial Sequence
  Synthesized
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 227 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 228 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 229 - protein, 487 aa, Artificial Sequence
  Synthesized
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 230 - DNA, 3527 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 231 - DNA, 3545 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 232 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 233 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 234 - DNA, 3527 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 235 - DNA, 3665 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 236 - protein, 530 aa, Artificial Sequence
  Synthesized
MALPVTALLLPLALLLHAARPMGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIRGGGGSGGGGSGGGGSMGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 237 - DNA, 3656 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 238 - DNA, 3656 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 239 - protein, 527 aa, Artificial Sequence
  Synthesized
MALPVTALLLPLALLLHAARPMGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIRGGGGSGGGGSGGGGSMGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAATTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 240 - DNA, 3665 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 241 - DNA, 3656 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 242 - DNA, 3656 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 243 - DNA, 3647 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 244 - DNA, 3518 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 245 - protein, 482 aa, Artificial Sequence
  Synthesized
MALPVTALLLPLALLLHAARPEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKGGGGSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 246 - DNA, 3509 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 247 - DNA, 3509 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 248 - protein, 479 aa, Artificial Sequence
  Synthesized
MALPVTALLLPLALLLHAARPEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKGGGGSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 249 - DNA, 3500 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 250 - DNA, 3518 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 251 - DNA, 3509 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 252 - DNA, 3509 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 253 - DNA, 3500 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 254 - DNA, 3545 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 255 - protein, 490 aa, Artificial Sequence
  Synthesized
MALPVTALLLPLALLLHAARPEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIKGGGGSGGGGSGGGGSQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 256 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 257 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 258 - protein, 487 aa, Artificial Sequence
  Synthesized
MALPVTALLLPLALLLHAARPEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIKGGGGSGGGGSGGGGSQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 259 - DNA, 3527 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 260 - DNA, 3545 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 261 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 262 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 263 - DNA, 3527 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 264 - protein, 505 aa, Artificial Sequence
  Synthezied
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 265 - protein, 505 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 266 - protein, 69 aa, Artificial Sequence; identical to SEQ ID NO: 30
  Synthesized

SEQ ID NO: 267 - protein, 66 aa, Artificial Sequence; identical to SEQ ID NO: 29
  Synthesized

SEQ ID NO: 268 - protein, 69 aa, Artificial Sequence; identical to SEQ ID NO: 2
  Synthesized

SEQ ID NO: 269 - protein, 72 aa, Artificial Sequence; identical to SEQ ID NO: 31
  Synthezied

SEQ ID NO: 270 - protein, 728 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 271 - protein, 725 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 272 - protein, 728 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSAKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 273 - protein, 731 aa, Artificial Sequence
  Synthezied
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 274 - protein, 728 aa, Artificial Sequence
  Synthezied
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 275 - protein, 725 aa, Artificial Sequence
  Synthezied
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 276 - protein, 728 aa, Artificial Sequence
  Synthezied
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 277 - protein, 731 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 278 - protein, 5 aa, Artificial Sequence
  Synthesized
GGGGS

SEQ ID NO: 279 - DNA, 1470 bp, Artificial Sequence
  Synthesized
atggccttaccagtgaccgccttgctcctgccgctggccttgctgctccacgccgccaggccgcagtccgtgctgacccagccaccttccgtgtctgccgctccaggccagaaggtgacaatcagctgctccggcagctcctctgacatcggaagcaactacgtgtcctggtaccagcagttcccaggcaccgcccccaagctgctgatctacgacaacaacaagaggcctagcgccatcccagatagattttctggcagcaagtccggaacctccgccacactgggcatcaccggactgcagacaggcgacgaggctgattactactgcggcacatgggattccaggctgggaatcgccgtgttcggaggaggaacccagctgacagtgctgggcggaggaggaggaagcggaggaggaggatccggaggaggaggatctgaggtgcagctggtgcagtctggcgccgaggtgaagaagcctggacagtctctgaagatcagctgtaaggcttccggctactctctgaccgacaactggatcggatgggtgcggcagaagccaggcaagggactggagtggatgggcatcatctacccaggagactctgatacacgctactctcccagctttcagggccaggtgaccatctccgccgataagtctatcaacacagcttacctgcagtggagctccctgaaggccagcgacaccgctatctactactgcgtgggcctggattggaactacaacccactgaggtactggggacctggaaccctggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 280 - protein, 69 aa, Homo sapiens; identical to SEQ ID NO: 30

SEQ ID NO: 281 - protein, 24 aa, Homo sapiens
IYIWAPLAGTCGVLLLSLVITLYC

SEQ ID NO: 282 - protein, 254 aa, Homo sapiens
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMIYIWAPLAGTCGVLLLSLVITLYC

SEQ ID NO: 283 - DNA, 462 bp, Homo sapiens
atgtacaggatgcaactcctgtcttgcattgcactaagtcttgcacttgtcacaaacagtgcacctacttcaagttctacaaagaaaacacagctacaactggagcatttactgctggatttacagatgattttgaatggaattaataattacaagaatcccaaactcaccaggatgctcacatttaagttttacatgcccaagaaggccacagaactgaaacatcttcagtgtctagaagaagaactcaaacctctggaggaagtgctaaatttagctcaaagcaaaaactttcacttaagacccagggacttaatcagcaatatcaacgtaatagttctggaactaaagggatctgaaacaacattcatgtgtgaatatgctgatgagacagcaaccattgtagaatttctgaacagatggattaccttttgtcaaagcatcatctcaacactgacttga

SEQ ID NO: 284 - DNA, 10179 bp, Homo sapiens
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtcgactctagaactagtaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgccgcggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttgaagatcctttgatcttttctacggggtctgacgctcagtggaacgaaaactcacgttaagggattttggtcatgaacaataaaactgtctgcttacataaacagtaatacaaggggtgttatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctggctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgatcacgagactagcctcgacacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttatcgacttaacttgtttattgcagcttataatggttacaaataaggcaatagcatcacaaatttcacaaataaggcatttttttcactgcattctagttttggtttgtccaaactcatcaatgtatcttatcatgtctggatctcaaatccctcggaagctgcgcctgtcttaggttggagtgatacatttttatcacttttacccgtctttggattaggcagtagctctgacggccctcctgtcttaggttagtgaaaaatgtcactctcttacccgtcattggctgtccagcttagctcgcaggggaggtggtcttcatcagctggcgttcaggtagctcatcacccggtcgatggtcacggcccggatccggaaggcatgcaggaggatgcacagcttgatcttggtcttgtagaagtcgggctcttccaggctggacttctggggcactgtctcgctgttgaagttcagggcctgcatcagctcgtcgatcacggccagcatgttctgatccaggaagatctgccgcttggggtccatcagcagcttggcgttcatggtcttgaactccacctggtacatcttcaggtcctcgtagatgctgctcaggcacagggccatcatgaagctggtctttctgctggccaggcaagagccgttggtgatgaagcttgtctcccgagagttcagacagctctcgttcttggtcagttccaggggcaggcaggcctccacggtgctggtcttatccttggtgatgtcctcgtggtcgatttcctcgctggtgcaggggtagaattccagggtctgccgggccttctgcagcatgttgctcacggcccgcagcaggttctggctgtggtgcaggcaggggaacatgccggggtcgggggtagccacgggcaggttccggcttcctccgccccctccgccgctgcagggcacgctggcccactcggaccaggagctgctgtagtaccggtcctgggcccgcacgctgatgctggcgttcttccggcagatcacggtggcgctggtcttgtcggtgaacacccggtctttcttctcccgcttgctcttgccctgcacctgcacacagaaggtcaggctgaagtagctgtggggggtggaccaggtgtcagggtactcccaggacacctccacctgccggctgttcttcaggggcttcagctgcaggttcttgggggggtcgggcttgatgatgtcccggatgaaaaagctggaggtgtagttctcgtacttcagcttgtgcacggcgtccaccatcacctcgatgggcaggctttcctcggcggcagggcaggcgctatcttcctggcactcgacgctgtactcgtactctttgttgtcgccccgcactctctcggcgctcagggtggcggctccgcaggtcacgccctgagggtcgctgctgccccggctgctcttcacgctgaaggtcaggtcggtgctgatggtggtcagccaccaacaggtgaaccggccgctgtagttcttggcctcgcaccgcaggaaggtcttgttcttgggctctttctggtccttcaggatgtcggtggaccagatgccatcctctttcttgtgcagcagcagcaggctgtgggacagcacttcgccgcccttgtggcaggtgtactggccggcgtcgccgaactctttgacctggatggtcagggtcttgccgctgcccagcacctcgctgctctggtccagggtccaggtgatgccgtcctcttcgggggtgtcgcaggtcagcaccaccatctcgccaggggcgtcgggataccagtccagctccaccacgtacacgtctttcttcagctcccagatggccaccagggggctggccaggaacaccaggctgaaccagctgatgaccagctgctgatgacacatggtggccaggagttgaggttactgtgagtagtgattaaagagagtgatagggaactcttgaacaagagatgcaatttatactgttaattctggaaaaatattatgggggtgtcaaaatgtcccgggaccaattgacgccttctgtatgaaacagtttttcctcctaattgacgccttctgtatgaaacagtttttcctcctaattgacgccttctgtatgaaacagtttttcctcctaattcgatgggaccaattgacgccttctgtatgaaacagtttttcctcctaattgacgccttctgtatgaaacagtttttcctcctaattgacgccttctgtatgaaacagtttttcctcctaattcgatatcaagcttatcgataccgtcgacctcgatgaattcgctagcaaatccactttggctcgagaagcttgatat

SEQ ID NO: 285 - protein, 153 aa, Homo sapiens
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 286 - DNA, 639 bp, Homo sapiens
atgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtag

SEQ ID NO: 287 - protein, 212 aa, Homo sapiens
MNSFSTSAFGPVAFSLGLLLVLPAAFPAPVPPGEDSKDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQM

SEQ ID NO: 288 - DNA, 534 bp, Homo sapiens
atgttccatgtttcttttaggtatatctttggacttcctcccctgatccttgttctgttgccagtagcatcatctgattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactga

SEQ ID NO: 289 - protein, 177 aa, Homo sapiens
MFHVSFRYIFGLPPLILVLLPVASSDCDIEGKDGKQYESVLMVSIDQLLDSMKEIGSNCLNNEFNFFKRHICDANKEGMFLFRAARKLRQFLKMNSTGDFDLHLLKVSEGTTILLNCTGQVKGRKPAALGEAQPTKSLEENKSLKEQKKLNDLCFLKRLLQEIKTCWNKILMGTKEH

SEQ ID NO: 290 - DNA, 489 bp, Homo sapiens
atgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttga

SEQ ID NO: 291 - protein, 162 aa, Homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 292 - DNA, 468 bp, Homo sapiens
atgactcctgggaagacctcattggtgtcactgctactgctgctgagcctggaggccatagtgaaggcaggaatcacaatcccacgaaatccaggatgcccaaattctgaggacaagaacttcccccggactgtgatggtcaacctgaacatccataaccggaataccaataccaatcccaaaaggtcctcagattactacaaccgatccacctcaccttggaatctccaccgcaatgaggaccctgagagatatccctctgtgatctgggaggcaaagtgccgccacttgggctgcatcaacgctgatgggaacgtggactaccacatgaactctgtccccatccagcaagagatcctggtcctgcgcagggagcctccacactgccccaactccttccggctggagaagatactggtgtccgtgggctgcacctgtgtcaccccgattgtccaccatgtggcctaa

SEQ ID NO: 293 - protein, 155 aa, Homo sapiens
MTPGKTSLVSLLLLLSLEAIVKAGITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 294 - DNA, 387 bp, Homo sapiens
atgaaaccgtatgcccgcatggaggagtatgagaggaacatcgaggagatggtggcccagctgaggaacagctcagagctggcccagagaaagtgtgaggtcaacttgcagctgtggatgtccaacaagaggagcctgtctccctggggctacagcatcaaccacgaccccagccgtatccccgtggacctgccggaggcacggtgcctgtgtctgggctgtgtgaaccccttcaccatgcaggaggaccgcagcatggtgagcgtgccggtgttcagccaggttcctgtgcgccgccgcctctgcccgccaccgccccgcacagggccttgccgccagcgcgcagtcatggagaccatcgctgtgggctgcacctgcatcttctga

SEQ ID NO: 295 - protein, 128 aa, Homo sapiens
MKPYARMEEYERNIEEMVAQLRNSSELAQRKCEVNLQLWMSNKRSLSPWGYSINHDPSRIPVDLPEARCLCLGCVNPFTMQEDRSMVSVPVFSQVPVRRRLCPPPPRTGPCRQRAVMETIAVGCTCIF

SEQ ID NO: 296 - DNA, 594 bp, Homo sapiens
atgacgctcctccccggcctcctgtttctgacctggctgcacacatgcctggcccaccatgacccctccctcagggggcacccccacagtcacggtaccccacactgctactcggctgaggaactgcccctcggccaggcccccccacacctgctggctcgaggtgccaagtgggggcaggctttgcctgtagccctggtgtccagcctggaggcagcaagccacagggggaggcacgagaggccctcagctacgacccagtgcccggtgctgcggccggaggaggtgttggaggcagacacccaccagcgctccatctcaccctggagataccgtgtggacacggatgaggaccgctatccacagaagctggccttcgccgagtgcctgtgcagaggctgtatcgatgcacggacgggccgcgagacagctgcgctcaactccgtgcggctgctccagagcctgctggtgctgcgccgccggccctgctcccgcgacggctcggggctccccacacctggggcctttgccttccacaccgagttcatccacgtccccgtcggctgcacctgcgtgctgccccgttcagtgtga

SEQ ID NO: 297 - protein, 197 aa, Homo sapiens
MTLLPGLLFLTWLHTCLAHHDPSLRGHPHSHGTPHCYSAEELPLGQAPPHLLARGAKWGQALPVALVSSLEAASHRGRHERPSATTQCPVLRPEEVLEADTHQRSISPWRYRVDTDEDRYPQKLAFAECLCRGCIDARTGRETAALNSVRLLQSLLVLRRRPCSRDGSGLPTPGAFAFHTEFIHVPVGCTCVLPRSV

SEQ ID NO: 298 - DNA, 609 bp, Homo sapiens
atgctggtagccggcttcctgctggcgctgccgccgagctgggccgcgggcgccccgagggcgggcaggcgccccgcgcggccgcggggctgcgcggaccggccggaggagctactggagcagctgtacgggcgcctggcggccggcgtgctcagtgccttccaccacacgctgcagctggggccgcgtgagcaggcgcgcaacgcgagctgcccggcagggggcaggcccgccgaccgccgcttccggccgcccaccaacctgcgcagcgtgtcgccctgggcctacagaatctcctacgacccggcgaggtaccccaggtacctgcctgaagcctactgcctgtgccggggctgcctgaccgggctgttcggcgaggaggacgtgcgcttccgcagcgcccctgtctacatgcccaccgtcgtcctgcgccgcacccccgcctgcgccggcggccgttccgtctacaccgaggcctacgtcaccatccccgtgggctgcacctgcgtccccgagccggagaaggacgcagacagcatcaactccagcatcgacaaacagggcgccaagctcctgctgggccccaacgacgcgcccgctggcccctga

SEQ ID NO: 299 - protein, 202 aa, Homo sapiens
MLVAGFLLALPPSWAAGAPRAGRRPARPRGCADRPEELLEQLYGRLAAGVLSAFHHTLQLGPREQARNASCPAGGRPADRRFRPPTNLRSVSPWAYRISYDPARYPRYLPEAYCLCRGCLTGLFGEEDVRFRSAPVYMPTVVLRRTPACAGGRSVYTEAYVTIPVGCTCVPEPEKDADSINSSIDKQGAKLLLGPNDAPAGP

SEQ ID NO: 300 - DNA, 492 bp, Homo sapiens
atgacagtgaagaccctgcatggcccagccatggtcaagtacttgctgctgtcgatattggggcttgcctttctgagtgaggcggcagctcggaaaatccccaaagtaggacatacttttttccaaaagcctgagagttgcccgcctgtgccaggaggtagtatgaagcttgacattggcatcatcaatgaaaaccagcgcgtttccatgtcacgtaacatcgagagccgctccacctccccctggaattacactgtcacttgggaccccaaccggtacccctcggaagttgtacaggcccagtgtaggaacttgggctgcatcaatgctcaaggaaaggaagacatctccatgaattccgttcccatccagcaagagaccctggtcgtccggaggaagcaccaaggctgctctgtttctttccagttggagaaggtgctggtgactgttggctgcacctgcgtcacccctgtcatccaccatgtgcagtaa

SEQ ID NO: 301 - protein, 163 aa, Homo sapiens
MTVKTLHGPAMVKYLLLSILGLAFLSEAAARKIPKVGHTFFQKPESCPPVPGGSMKLDIGIINENQRVSMSRNIESRSTSPWNYTVTWDPNRYPSEVVQAQCRNLGCINAQGKEDISMNSVPIQQETLVVRRKHQGCSVSFQLEKVLVTVGCTCVTPVIHHVQ

SEQ ID NO: 302 - DNA, 570 bp, Homo sapiens
atgctggggagcagagctgtaatgctgctgttgctgctgccctggacagctcagggcagagctgtgcctgggggcagcagccctgcctggactcagtgccagcagctttcacagaagctctgcacactggcctggagtgcacatccactagtgggacacatggatctaagagaagagggagatgaagagactacaaatgatgttccccatatccagtgtggagatggctgtgacccccaaggactcagggacaacagtcagttctgcttgcaaaggatccaccagggtctgattttttatgagaagctgctaggatcggatattttcacaggggagccttctctgctccctgatagccctgtgggccagcttcatgcctccctactgggcctcagccaactcctgcagcctgagggtcaccactgggagactcagcagattccaagcctcagtcccagccagccatggcagcgtctccttctccgcttcaaaatccttcgcagcctccaggcctttgtggctgtagccgcccgggtctttgcccatggagcagcaaccctgagtccctaa

SEQ ID NO: 303 - protein, 189 aa, Homo sapiens
MLGSRAVMLLLLLPWTAQGRAVPGGSSPAWTQCQQLSQKLCTLAWSAHPLVGHMDLREEGDEETTNDVPHIQCGDGCDPQGLRDNSQFCLQRIHQGLIFYEKLLGSDIFTGEPSLLPDSPVGQLHASLLGLSQLLQPEGHHWETQQIPSLSPSQPWQRLLLRFKILRSLQAFVAVAARVFAHGAATLSP

SEQ ID NO: 304 - DNA, 570 bp, Homo sapiens
atggctgctgaaccagtagaagacaattgcatcaactttgtggcaatgaaatttattgacaatacgctttactttatagaaaacctggaatcagattactttggcaagcttgaatctaaattatcagtcataagaaatttgaatgaccaagttctcttcattgaccaaggaaatcggcctctatttgaagatatgactgattctgactgtagagataatgcaccccggaccatatttattataagtatgtataaagatagccagcctagaggtatggctgtaactatctctgtgaagtgtgagaaaatttcaactctctcctgtgagaacaaaattatttcctttaaggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactag

SEQ ID NO: 305 - protein, 189 aa, Homo sapiens
MAAEPVEDNCINFVAMKFIDNTLYFIENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 306 - DNA, 762 bp, Homo sapiens
atgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaa

SEQ ID NO: 307 - protein, 253 aa, Homo sapiens
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 308 - DNA, 987 bp, Homo sapiens
atgtgtcaccagcagttggtcatctcttggttttccctggtttttctggcatctcccctcgtggccatatgggaactgaagaaagatgtttatgtcgtagaattggattggtatccggatgcccctggagaaatggtggtcctcacctgtgacacccctgaagaagatggtatcacctggaccttggaccagagcagtgaggtcttaggctctggcaaaaccctgaccatccaagtcaaagagtttggagatgctggccagtacacctgtcacaaaggaggcgaggttctaagccattcgctcctgctgcttcacaaaaaggaagatggaatttggtccactgatattttaaaggaccagaaagaacccaaaaataagacctttctaagatgcgaggccaagaattattctggacgtttcacctgctggtggctgacgacaatcagtactgatttgacattcagtgtcaaaagcagcagaggctcttctgacccccaaggggtgacgtgcggagctgctacactctctgcagagagagtcagaggggacaacaaggagtatgagtactcagtggagtgccaggaggacagtgcctgcccagctgctgaggagagtctgcccattgaggtcatggtggatgccgttcacaagctcaagtatgaaaactacaccagcagcttcttcatcagggacatcatcaaacctgacccacccaagaacttgcagctgaagccattaaagaattctcggcaggtggaggtcagctgggagtaccctgacacctggagtactccacattcctacttctccctgacattctgcgttcaggtccagggcaagagcaagagagaaaagaaagatagagtcttcacggacaagacctcagccacggtcatctgccgcaaaaatgccagcattagcgtgcgggcccaggaccgctactatagctcatcttggagcgaatgggcatctgtgccctgcagttag

SEQ ID NO: 309 - protein, 328 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 310 - protein, 532 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 311 - protein, 505 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGGGSRAVPGGSSPAWTQCQQLSQKLCTLAWSAHPLVGHMDLREEGDEETTNDVPHIQCGDGCDPQGLRDNSQFCLQRIHQGLIFYEKLLGSDIFTGEPSLLPDSPVGQLHASLLGLSQLLQPEGHHWETQQIPSLSPSQPWQRLLLRFKILRSLQAFVAVAARVFAHGAATLSP

SEQ ID NO: 312 - protein, 601 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASTTTPAPRPPTPAPTIASQPLSLRPEACRPAAGGAVHTRGLDFACDIYIWAPLAGTCGVLLLSLVITLYC

SEQ ID NO: 313 - protein, 786 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMIYIWAPLAGTCGVLLLSLVITLYC

SEQ ID NO: 314 - protein, 219 aa, Homo sapiens
HYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 315 - protein, 191 aa, Homo sapiens
YRVDLVLFYRHLTRRDETLTDGKTYDAFVSYLKECRPENGEEHTFAVEILPRVLEKHFGYKLCIFERDVVPGGAVVDEIHSLIEKSRRLIIVLSKSYMSNEVRYELESGLHEALVERKIKIILIEFTPVTDFTFLPQSLKLLKSHRVLKWKADKSLSYNSRFWKNLLYLMPAKTVKPGRDEPEVLPVLSES

SEQ ID NO: 316 - protein, 253 aa, Homo sapiens
NRSFRTGIKRRILLLIPKWLYEDIPNMKNSNVVKMLQENSELMNNNSSEQVLYVDPMITEIKEIFIPEHKPTDYKKENTGPLETRDYPQNSLFDNTTVVYIPDLNTGYKPQISNFLPEGSHLSNNNEITSLTLKPPVDSLDSGNNPRLQKHPNFAFSVSSVNSLSNTIFLGELSLILNQGECSSPDIQNSVEEETTMLLENDSPSETIPEQTLLPDEFVSCLGIVNEELPSINTYFPQNILESHFNRISLLEK

SEQ ID NO: 317 - protein, 277 aa, Homo sapiens
NKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 318 - protein, 39 aa, Homo sapiens
KSRQTPPLASVEMEAMEALPVTWGTSSRDEDLENCSHHL

SEQ ID NO: 319 - protein, 662 aa, Homo sapiens
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 320 - protein, 373 aa, Artificial Sequence
  Synthesized
KRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 321 - protein, 373 aa, Artificial Sequence
  Synthesized
KRGRKKLLYIFKQPFMRPVQTTQEEDGCSCRFPEEEEGGCELHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLMLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 322 - protein, 373 aa, Artificial Sequence
  Synthesized
HYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLMLKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 323 - DNA, 1117 bp, Artificial Sequence
  Synthesized
aatgctttgtcctggagagctatcttaagggacaaaatcgttttcccagcgtcatctgtgacacatcctgacagtagagagctgcttccaagaagcaatttgaagtgccattatcaggcagggacgggggctctaggggatttcggggtcagcagatatgaaatgaatgatttcatagggctgtcacagagctgtggtgggaatttcccatgagaccccgcccctggctgagtcaccgcactcctgtgtttgacctgaagtcctctcgagctgcagaagcctgaagaccaaggagtggaaagttctccggcagccctgagatctcaaggtctgtccatctgggggagtgggtgggggcactgagaaggggtgagattggaacttttgctccctttgcccatttctagactttttctcctaatatgtaataacttctcttcaatagccctttaaataaacatcaataacttagcctgaagagtttttcactccttagttttgttaccatacaaacttcacatctcaaaacatgtctctgtttaagaaaatgtgttagtgagttgaacagggaggtctttccacatgttagtagttaggtgttcagctaaagggggaagagtgattatgtgatagcttcttcttgaactgaattgtctgatgcccctgacagattctctttgtaaggagtttatttcaggggcaataagtaattggcattattgctggttggtactgcaaagtacctatgaaagtccccaaaagttcttgctattgttatttctgcattttggcagaacatgatggaaaatgcaccctcaaactttggcaaaccggcacaaagctgtgtgtttaatcacgcctgccttgtcctagtggtttctatgaatctgctacttttccgtaatattgcatcattaattgttcctgaaaaaccctgagttatcctcttatagaattgtataagtaatgattgcaatatagataattttgaaaggagaaaccacctttccttggaaatgtttatcttttgcagagtgacatttgtgagaccagctaatttgattaaaattctcttggaatcagctttgctagtatcatacctgtgccagatttcatc

SEQ ID NO: 324 - DNA, 590 bp, Artificial Sequence
  Synthesized
agtgaggcggtacccacagagccgcgtggcactcctcaacctgctagagcagccggcctcctgcaggatggcttaaggaccacctggtccttggggtctgggttctccgggtcctgctgttccctgcagccttccttctacccccagagcagcttgggggcatctttagagaaagcggcagtgtcgcacctgccccagcagccacaaaacagaggaaattctgagcacctccgggcgtgagtcaccataccacattcaggaattgccacctctgcccacagaatcacccactcttttctgtttgggaccaaaatagatacctccttcagaagccgctgctttctgtactctcagcaataaaaaaacaaaggctaggataggtgtgtgcctctgaggcgtgagggggggcgcgttttctcccctgggaaggttttcagagagaagttgttgctacagcagtacaggcagctgatgggttgagggtacaggaggaagagggatggcctcggcggccaagcttagacactagagggtatataatggaagctcgacttccagcttggcaatccggtactgttggtaaagccacc

SEQ ID NO: 325 - DNA, 687 bp, Artificial Sequence
  Synthesized
tgagagaggatgatgtattctaaattgaagttttgattcacaagaagattaaaagccattcagaaacctaattcacccactgaaaggaaaaaaaaaaaagagagatgagcagtttgtctccggaaattgtcttaggtcggaagtctgtggtccctgttcacatgtacccaaaagcatcctgctgctgcagctgtctgataagcacagagtaccccaccttctctgcacactttgcatctagctcatattacctcatctttacttcctttctgacgtctcaccctggattctacatataaggtcacacaggaaggaaagctgcattgagttttggtgtcctgaaagacttttgccaaccttgtccccgcactaatttctctaagcctcggctatactattttctcagctacacgatgaaatgtgaatgataatttctgccctaaaaatatcacttaattttttaacatatcatttatgaaagaagacacataaaatgtctccctaaaatggaaagttacatattattgccatctgtgttttataaagaggttgaaaggggtggtacctgagctcgctagcctcgaggatatcaagatctggcctcggcggccaagcttagacactagagggtatataatggaagctcgacttccagcttggcaatccggtactgttggtaaagccacc

SEQ ID NO: 326 - DNA, 688 bp, Homo sapiens
tttctactgggcagtgctgatctagagcaatttgaaacttgtggtagatattttactaaccaactctgatgaaggacttcctcaccaaattgttcttttaaccgcattctttccttgctttctggtcatttgcaagaaaaattttaaaaggctgcccctttgtaaaggtttgagaggccctagaatttcgtttttcacttgttcccaaccacaagcaaatgatcaatgtgctttgtgaatgaagagtcaacattttaccagggcgaagtggggaggtacaaaaaaatttccagtccttgaatggtgtgaagtaaaagtgccttcaaagaatcccaccagaatggcacaggtgggcataatgggtctgtctcatcgtcaaaggacccaaggagtctaaaggaaactctaactacaacacccaaatgccacaaaaccttagttattaatacaaactatcatccctgcctatctgtcaccatctcatcttaaaaaacttgtgaaaatacgtaatcctcaggagacttcaattaggtataaataccagcagccagaggaggtgcagcacattgttctgatcatctgaagatcagctattagaagagaaagatcagttaagtcctttggacctgatcagcttgatacaagaactactgatttcaacttctttggcttaattctctcggaaacg

SEQ ID NO: 327 - DNA, 57 bp, Homo sapiens
gccacgaacttctctctgttaaagcaagcaggagacgtggaagaaaaccccggtcct

SEQ ID NO: 328 - protein, 166 aa, Homo sapiens
MKYTSYILAFQLCIVLGSLGCYCQDPYVKEAENLKKYFNAGHSDVADNGTLFLGILKNWKEESDRKIMQSQIVSFYFKLFKNFKDDQSIQKSVETIKEDMNVKFFNSNKKKRDDFEKLTNYSVTDLNVQRKAIHELIQVMAELSPAAKTGKRKRSQMLFRGRRASQ

SEQ ID NO: 329 - protein, 326 aa, Homo sapiens
EETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQ

SEQ ID NO: 330 - DNA, 76 bp, Homo sapiens
gtgactacgtgctgcctaggtgactacgtgctgcctaggtgactacgtgctgcctaggtgactacgtgctgcctag

SEQ ID NO: 331 - DNA, 72 bp, Homo sapiens
tgtcacgtcctgcacgactctagttgtcacgtcctgcacgactctagttgtcacgtcctgcacgacgctagc

SEQ ID NO: 332 - DNA, 277 bp, Homo sapiens
tcgaggtcgacggtatcgataagcttgatatcgaattaggaggaaaaactgtttcatacagaaggcgtcaattaggaggaaaaactgtttcatacagaaggcgtcaattaggaggaaaaactgtttcatacagaaggcgtcaattggtcccatcgaattaggaggaaaaactgtttcatacagaaggcgtcaattaggaggaaaaactgtttcatacagaaggcgtcaattaggaggaaaaactgtttcatacagaaggcgtcaattggtcccggga

SEQ ID NO: 333 - DNA, 90 bp, Homo sapiens
acgccttctgtatgaaacagtttttcctccacgccttctgtatgaaacagtttttcctccacgccttctgtatgaaacagtttttcctcc

SEQ ID NO: 334 - DNA, 99 bp, Homo sapiens
caaggtaaacaagagtaaacaagtcaaggtaaacaagagtaaacaagtccaaggtaaacaagagtaaacaagtccaaggtaaacaagagtaaacaagtc

SEQ ID NO: 335 - DNA, 54 bp, Homo sapiens
cagtacgtgcagtacgtgcagtacgtgcagtacgtgcagtacgtgcagtacgtg

SEQ ID NO: 336 - DNA, 92 bp, Homo sapiens
ggatctgcgatcgctgaattctggggactttccactggggactttccactggggactttccactggggactttccactggggactttccact

SEQ ID NO: 337 - DNA, 52 bp, Homo sapiens
gggaatttccggggactttccgggaatttccggggactttccgggaatttcc

SEQ ID NO: 338 - DNA, 84 bp, Homo sapiens
tacgctcgcttcgacagcggagactctagagggtatataatgggagctcgaattccagcttggcattccggtactgttggtaaa

SEQ ID NO: 339 - DNA, 108 bp, Homo sapiens
ctcgaggatatcaagatctggcctcggcggccaagcttagacactagagggtatataatggaagctcgacttccagcttggcaatccggtactgttggtaaagccacc

SEQ ID NO: 340 - DNA, 206 bp, Homo sapiens
tcgagatccggccccgcccagcgtcttgtcattggcgaattcgaacacgcagatgcagtcggggcggcgcggtccgaggtccacttcgcatattaaggtgacgcgtgtggcctcgaacaccgagcgaccctgcagcgacccgcttaacagcgtcaacagcgtgccgcagatctaagtaagcttggcattccggtactgttggtaaa

SEQ ID NO: 341 - DNA, 113 bp, Homo sapiens
cattttgacacccccataatatttttccagaattaacagtataaattgcatctcttgttcaagagttccctatcactctctttaatcactactcacagtaacctcaactcctg

SEQ ID NO: 342 - DNA, 115 bp, Homo sapiens
ggggatctggcgcggtcccaggtccacttcgcatattaaggtgacgcgtgtggcctcgaacaccgagcgaccctgcagcgacccgcaagcttggcattccggtactgttggtaaa

SEQ ID NO: 343 - DNA, 322 bp, Homo sapiens
ctttcaggtaggcctgtgcctttttcagcgggctgcagttctcctgcttggcttgagtcattcgcatttcctgagagctgggtagagggggagttgtggaggagcccattctgaaactgatctgatattgcaaacccatacacggaaaggaagaactgcccatacgtattcgagtcttccaatctgactccgagcccgcatccccctcaatcgtctcttttccccactccccagatcacggtgctgcttggtccccctcagagccatagagaagcagggggtgtggccatggaggggaaacctctgtcaccagagactttac

SEQ ID NO: 344 - DNA, 84 bp, Homo sapiens; identical to SEQ ID NO: 338

SEQ ID NO: 345 - DNA, 192 bp, Homo sapiens
cctgcagcagtggatattcccagaaaactttttggatgcagttggggatttcctctttactggatgtggacaatatcctcctattattcacaggaagcaatccctcctataaaagggcctcagcagaagtagtgttcagctgttcttggctgacttcacatcaaagcttctatactgacctgagacagagcc

SEQ ID NO: 346 - DNA, 95 bp, Homo sapiens
agatctggcctcggcggccaagcttagacactagagggtatataatggaagctcgacttccagcttggcaatccggtactgttggtaaagccacc

SEQ ID NO: 347 - protein, 233 aa, Homo sapiens
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 348 - protein, 244 aa, Homo sapiens
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 349 - protein, 183 aa, Homo sapiens
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 350 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 351 - protein, 281 aa, Homo sapiens
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 352 - protein, 193 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 353 - protein, 234 aa, Homo sapiens
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 354 - protein, 254 aa, Homo sapiens
MEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 355 - protein, 281 aa, Homo sapiens [sequence omitted]

SEQ ID NO: 356 - protein, 317 aa, Homo sapiens
MRRASRDYTKYLRGSEEMGGGPGAPHEGPLHAPPPPAPHQPPAASRSMFVALLGLGLGQVVCSVALFFYFRAQMDPNRISEDGTHCIYRILRLHENADFQDTTLESQDTKLIPDSCRRIKQAFQGAVQKELQHIVGSQHIRAEKAMVDGSWLDLAKRSKLEAQPFAHLTINATDIPSGSHKVSLSSWYHDRGWAKISNMTFSNGKLIVNQDGFYYLYANICFRHHETSGDLATEYLQLMVYVTKTSIKIPSSHTLMKGGSTKYWSGNSEFHFYSINVGGFFKLRSGEEISIEVSNPSLLDPDQDATYFGAFKVRDID

SEQ ID NO: 357 - protein, 249 aa, Homo sapiens
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 358 - protein, 250 aa, Homo sapiens [sequence omitted]

SEQ ID NO: 359 - protein, 240 aa, Homo sapiens
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 360 - protein, 241 aa, Homo sapiens
MSMLFYTLITAFLIGIQAEPHSESNVPAGHTIPQAHWTKLQHSLDTALRRARSAPAAAIAARVAGQTRNITVDPRLFKKRRLRSPRVLFSTQPPREAADTQDLDFEVGGAAPFNRTHRSKRSSSHPIFHRGEFSVCDSVSVWVGDKTTATDIKGKEVMVLGEVNINNSVFKQYFFETKCRDPNPVDSGCRGIDSKHWNSYCTTTHTFVKALTMDGKQAAWRFIRIDTACVCVLSRKAVRRA

SEQ ID NO: 361 - protein, 199 aa, Homo sapiens
MTLHPSPITCEFLFSTALISPKMCLSHLENMPLSHSRTQGAQRSSWKLWLFCSIVMLLFLCSFSWLIFIFLQLETAKEPCMAKFGPLPSKWQMASSEPPCVNKVSDWKLEILQNGLYLIYGQVAPNANYNDVAPFEVRLYKNKDMIQTLTNKSKIQNVGGTYELHVGDTIDLIFNSEHQVLKNNTYWGIILLANPQFIS

SEQ ID NO: 362 - protein, 251 aa, Homo sapiens
MAEDLGLSFGETASVEMLPEHGSCRPKARSSSARWALTCCLVLLPFLAGLTTYLLVSQLRAQGEACVQFQALKGQEFAPSHQQVYAPLRADGDKPRAHLTVVRQTPTQHFKNQFPALHWEHELGLAFTKNRMNYTNKFLLIPESGDYFIYSQVTFRGMTSECSEIRQAGRPNKPDSITVVITKVTDSYPEPTQLLMGTKSVCEVGSNWFQPIYLGAMFSLQEGDKLMVNVSDISLVDYTKEDKTFFGAFLL

SEQ ID NO: 363 - protein, 391 aa, Homo sapiens
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTAGVCLLKARQKIAVKMVHADISINMSKHTTFFGAIRLGEAPAS

SEQ ID NO: 364 - protein, 107 aa, Homo sapiens
MARAALSAAPSNPRLLRVALLLLLLVAAGRRAAGASVATELRCQCLQTLQGIHPKNIQSVNVKSPGPHCAQTEVIATLKNGRKACLNPASPIVKKIIEKMLNSDKSN

SEQ ID NO: 365 - protein, 107 aa, Homo sapiens
MARATLSAAPSNPRLLRVALLLLLLVAASRRAAGAPLATELRCQCLQTLQGIHLKNIQSVKVKSPGPHCAQTEVIATLKNGQKACLNPASPMVKKIIEKMLKNGKSN

SEQ ID NO: 366 - protein, 107 aa, Homo sapiens
MAHATLSAAPSNPRLLRVALLLLLLVAASRRAAGASVVTELRCQCLQTLQGIHLKNIQSVNVRSPGPHCAQTEVIATLKNGKKACLNPASPMVQKIIEKILNKGSTN

SEQ ID NO: 367 - protein, 101 aa, Homo sapiens
MSSAAGFCASRPGLLFLGLLLLPLVVAFASAEAEEDGDLQCLCVKTTSQVRPRHITSLEVIKAGPHCPTAQLIATLKNGRKICLDLQAPLYKKIIKKLLES

SEQ ID NO: 368 - protein, 114 aa, Homo sapiens
MSLLSSRAARVPGPSSSLCALLVLLLLLTQPGPIASAGPAAAVLRELRCVCLQTTQGVHPKMISNLQVFAIGPQCSKVEVVASLKNGKEICLDPEAPFLKKVIQKILDGGNKEN

SEQ ID NO: 369 - protein, 114 aa, Homo sapiens; identical to SEQ ID NO: 368

SEQ ID NO: 370 - protein, 128 aa, Homo sapiens
MSLRLDTTPSCNSARPLHALQVLLLLSLLLTALASSTKGQTKRNLAKGKEESLDSDLYAELRCMCIKTTSGIHPKNIQSLEVIGKGTHCNQVEVIATLKDGRKICLDPDAPRIKKIVQKKLAGDESAD

SEQ ID NO: 371 - protein, 99 aa, Homo sapiens
MTSKLAVALLAAFLISAALCEGAVLPRSAKELRCQCIKTYSKPFHPKFIKELRVIESGPHCANTEIIVKLSDGRELCLDPKENWVQRVVEKFLKRAENS

SEQ ID NO: 372 - protein, 125 aa, Homo sapiens
MKKSGVLFLLGIILLVLIGVQGTPVVRKGRCSCISTNQGTIHLQSLKDLKQFAPSPSCEKIEIIATLKNGVQTCLNPDSADVKELIKKWEKQVSQKKKQKNGKKHQKKKVLKVRKSQRSRQKKTT

SEQ ID NO: 373 - protein, 98 aa, Homo sapiens
MNQTAILICCLIFLTLSGIQGVPLSRTVRCTCISISNQPVNPRSLEKLEIIPASQFCPRVEIIATMKKKGEKRCLNPESKAIKNLLKAVSKERSKRSP

SEQ ID NO: 374 - protein, 94 aa, Homo sapiens
MSVKGMAIALAVILCATVVQGFPMFKRGRCLCIGPGVKAVKVADIEKASIMYPSNNCDKIEVIITLKENKGQRCLNPKSKQARLIIKKVERKNF

SEQ ID NO: 375 - protein, 93 aa, Homo sapiens
MNAKVVVVLVLVLTALCLSDGKPVSLSYRCPCRFFESHVARANVKHLKILNTPNCALQIVARLKNNNRQVCIDPKLKWIQEYLEKALNKRFKM

SEQ ID NO: 376 - protein, 109 aa, Homo sapiens
MKFISTSLLLMLLVSSLSPVQGVLEVYYTSLRCRCVQESSVFIPRRFIDRIQILPRGNGCPRKEIIVWKKNKSIVCVDPQAEWIQRMMEVLRKRSSSTLPVPVFKRKIP

SEQ ID NO: 377 - protein, 111 aa, Homo sapiens
MSLLPRRAPPVSMRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 378 - protein, 96 aa, Homo sapiens
MQIITTALVCLLLAGMWPEDVDSKSMQVPFSRCCFSFAEQEIPLRAILCYRNTSSICSNEGLIFKLKRGKEACALDTVGWVQRHRKMLRHCPSKRK

SEQ ID NO: 379 - protein, 99 aa, Homo sapiens
MKVSAALLCLLLIAATFIPQGLAQPDAINAPVTCCYNFTNRKISVQRLASYRRITSSKCPKEAVIFKTIVAKEICADPKQKWVQDSMDHLDKQTQTPKT

SEQ ID NO: 380 - protein, 92 aa, Homo sapiens
MQVSTAALAVLLCTMALCNQFSASLAADTPTACCFSYTSRQIPQNFIADYFETSSQCSKPGVIFLTKRSRQVCADPSEEWVQKYVSDLELSA

SEQ ID NO: 381 - protein, 93 aa, Homo sapiens
MQVSTAALAVLLCTMALCNQVLSAPLAADTPTACCFSYTSRQIPQNFIADYFETSSQCSKPSVIFLTKRGRQVCADPSEEWVQKYVSDLELSA

SEQ ID NO: 382 - protein, 92 aa, Homo sapiens
MKLCVTVLSLLMLVAAFCSPALSAPMGSDPPTACCFSYTARKLPRNFVVDYYETSSLCSQPAVVFQTKRSKQVCADPSESWVQEYVYDLELN

SEQ ID NO: 383 - protein, 91 aa, Homo sapiens
MKVSAAALAVILIATALCAPASASPYSSDTTPCCFAYIARPLPRAHIKEYFYTSGKCSNPAVVFVTRKNRQVCANPEKKWVREYINSLEMS

SEQ ID NO: 384 - protein, 99 aa, Homo sapiens
MKASAALLCLLLTAAAFSPQGLAQPVGINTSTTCCYRFINKKIPKQRLESYRRTTSSHCPREAVIFKTKLDKEICADPTQKWVQDFMKHLDKKTQTPKL

SEQ ID NO: 385 - protein, 99 aa, Homo sapiens
MKVSAALLCLLLMAATFSPQGLAQPDSVSIPITCCFNVINRKIPIQRLESYTRITNIQCPKEAVIFKTKRGKEVCADPKERWVRDSMKHLDQIFQNLKP

SEQ ID NO: 386 - protein, 97 aa, Homo sapiens
MKVSAALLWLLLIAAAFSPQGLAGPASVPTTCCFNLANRKIPLQRLESYRRITSGKCPQKAVIFKTKLAKDICADPKKKWVQDSMKYLDQKSPTPKP

SEQ ID NO: 387 - protein, 98 aa, Homo sapiens
MKVSAVLLCLLLMTAAFNPQGLAQPDALNVPSTCCFTFSSKKISLQRLKSYVITTSRCPQKAVIFRTKLGKEICADPKEKWVQNYMKHLGRKAHTLKT

SEQ ID NO: 388 - protein, 93 aa, Homo sapiens
MKISVAAIPFFLLITIALGTKTESSSRGPYHPSECCFTYTTYKIPRQRIMDYYETNSQCSKPGIVFITKRGHSVCTNPSDKWVQDYIKDMKEN

SEQ ID NO: 389 - protein, 113 aa, Homo sapiens
MKVSVAALSCLMLVAVLGSQAQFINDAETELMMSKLPLENPVVLNSFHFAADCCTSYISQSIPCSLMKSYFETSSECSKPGVIFLTKKGRQVCAKPSGPGVQDCMKKLKPYSI

SEQ ID NO: 390 - protein, 120 aa, Homo sapiens
MKVSEAALSLLVLILIITSASRSQPKVPEWVNTPSTCCLKYYEKVLPRRLVVGYRKALNCHLPAIIFVTKRNREVCTNPNDDWVQEYIKDPNLPLLPTRNLSTVKIITAKNGQPQLLNSQ

SEQ ID NO: 391 - protein, 94 aa, Homo sapiens
MAPLKMLALVTLLLGASLQHIHAARGTNVGRECCLEYFKGAIPLRKLKTWYQTSEDCSRDAIVFVTVQGRAICSDPNNKRVKNAVKYLQSLERS

SEQ ID NO: 392 - protein, 89 aa, Homo sapiens
MKGLAAALLVLVCTMALCSCAQVGTNKELCCLVYTSWQIPQKFIVDYSETSPQCPKPGVILLTKRGRQICADPNKKWVQKYISDLKLNA

SEQ ID NO: 393 - protein, 98 aa, Homo sapiens
MALLLALSLLVLWTSPAPTLSGTNDAEDCCLSVTQKPIPGYIVRNFHYLLIKDGCRVPAVVFTTLRGRQLCAPPDQPWVERIIQRLQRTSAKMKRRSS

SEQ ID NO: 394 - protein, 96 aa, Homo sapiens
MCCTKSLLLAALMSVLLLHLCGESEAASNFDCCLGYTDRILHPKFIVGFTRQLANEGCDINAIIFHTKKKLSVCANPKQTWVKYIVRLLSKKVKNM

SEQ ID NO: 395 - protein, 134 aa, Homo sapiens
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKRTERSQTPKGP

SEQ ID NO: 396 - protein, 93 aa, Homo sapiens
MDRLQTALLVVLVLLAVALQATEAGPYGANMEDSVCCRDYVRYRLPLRVVKHFYWTSDSCPRPGVVLLTFRDKEICADPRVPWVKMILNKLSQ

SEQ ID NO: 397 - protein, 120 aa, Homo sapiens
MKVSVAALSCLMLVTALGSQARVTKDAETEFMMSKLPLENPVLLDRFHATSADCCISYTPRSIPCSLLESYFETNSECSKPGVIFLTKKGRRFCANPSDKQVQVCVRMLKLDTRIKTRKN

SEQ ID NO: 398 - protein, 119 aa, Homo sapiens
MAGLMTIVTSLLFLGVCAHHIIPTGSVVIPSPCCMFFVSKRIPENRVVSYQLSSRSTCLKAGVIFTTKKGQQFCGDPKQEWVQRYMKNLDAKQKKASPRARAVAVKGPVQRYPGNQTTC

SEQ ID NO: 399 - protein, 150 aa, Homo sapiens
MNLWLLACLVAGFLGAWAPAVHTQGVFEDCCLAYHYPIGWAVLRRAWTYRIQEVSGSCNLPAAIFYLPKRHRKVCGNPKSREVQRAMKLLDARNKVFAKLHHNTQTFQAGPHAVKKLSSGNSKLSSSKFSNPISSSKRNVSLLISANSGL

SEQ ID NO: 400 - protein, 94 aa, Homo sapiens
MMGLSLASAVLLASLLSLHLGTATRGSDISKTCCFQYSHKPLPWTWVRSYEFTSNSCSQRAVIFTTKRGKKVCTHPRKKWVQKYISLLKTPKQL

SEQ ID NO: 401 - protein, 112 aa, Homo sapiens
MKGPPTFCSLLLLSLLLSPDPTAAFLLPPSTACCTQLYRKPLSDKLLRKVIQVELQEADGDCHLQAFVLHLAQRSICIHPQNPSLSQWFEHQERKLHGTLPKLNFGMLRKMG

SEQ ID NO: 402 - protein, 127 aa, Homo sapiens
MQQRGLAIVALAVCAALHASEAILPIASSCCTEVSHHISRRLLERVNMCRIQRADGDCDLAAVILHVKRRRICVSPHNHTVKQWMKVQAAKKNGKGNVCHRKKHHGKRNSNRAHQGKHETYGHKTPY

SEQ ID NO: 403 - protein, 114 aa, Homo sapiens
MRLLILALLGICSLTAYIVEGVGSEVSDKRTCVSLTTQRLPVSRIKTYTITEGSLRAVIFITKRGLKVCADPQATWVRDVVRSMDRKSNTRNNMIQTKPTGTQQSTNTAVTLTG

SEQ ID NO: 404 - protein, 397 aa, Homo sapiens
MAPISLSWLLRLATFCHLTVLLAGQHHGVTKCNITCSKMTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQAVGLLAFLGLLFCLGVAMFTYQSLQGCPRKMAGEMAEGLRYIPRSCGSNSYVLVPV

SEQ ID NO: 405 - protein, 302 aa, Homo sapiens
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 406 - protein, 288 aa, Homo sapiens
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 407 - protein, 329 aa, Homo sapiens
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 408 - protein, 365 aa, Artificial Sequence
  Synthesized
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPLCSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 409 - protein, 272 aa, Artificial Sequence
  Synthesized
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 410 - protein, 240 aa, Artificial Sequence
  Synthesized
DIVMTQSHKFMSTSIGARVSITCKASQDVRTAVAWYQQKPGQSPKLLIYSASYRYTGVPDRFTGSGSGTDFTFTISSVQAEDLAVYYCQQHYGTPPWTFGGGTKLEIKGGGGSGGGGSGGGGSEVQLVESGGGLVKPGGSLKLSCEASRFTFSSYAMSWVRQTPEKRLEWVAAISGGGRYTYYPDSMKGRFTISRDNAKNFLYLQMSSLRSEDTAMYYCARHYDGYLDYWGQGTTLTVSS

SEQ ID NO: 411 - protein, 238 aa, Artificial Sequence
  Synthesized
DIVMTQSHKFMSTSIGARVSITCKASQDVRTAVAWYQQKPGQSPKWYSASYRYTGVPDRFTGSGSGTDFTFTISSVQAEDLAVYYCQQHYGTPPWTFGGGTKLEIKGGGGSGGGGSGGGGSEVQLVESGGGLVKPGGSLKLSCEASRFTFSSYAMSWVRQTPEKRLEWVAAISGGGRYTYYPDSMKGRFTISRDNAKNFLYLQMSSLRSEDTAMYYCARHYDGYLDYWGQGTTLTVSS

SEQ ID NO: 412 - protein, 244 aa, Artificial Sequence
  Synthesized
EVQLVESGGGLVQPGGSLRLSCAASGFTFSSFGMHWVRQAPGKGLEWVAYISSDSSAIYYADTVKGRFTISRDNAKNSLYLQMNSLRDEDTAVYYCGRGRENIYYGSRLDYWGQGTTVTVSSGGGGSGGGGSGGGGSDIQLTQSPSFLSASVGDRVTITCKASQNVDTNVAWYQQKPGKAPKALIYSASYRYSGVPSRFSGSGSGTDFTLTISSLQPEDFATYYCQQYNNYPFTFGQGTKLEIK

SEQ ID NO: 413 - protein, 219 aa, Homo sapiens
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQ

SEQ ID NO: 414 - protein, 19 aa, Homo sapiens
VAVAGCVFLLISVLLLSGL

SEQ ID NO: 415 - protein, 13 aa, Homo sapiens
TWQRRQRKSRRTI

SEQ ID NO: 416 - protein, 346 aa, Homo sapiens
LAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLP

SEQ ID NO: 417 - protein, 21 aa, Homo sapiens
TFLVAGGSLAFGTLLCIAIVL

SEQ ID NO: 418 - protein, 82 aa, Homo sapiens
RFKKTWKLRALKEGKTSMHPPYSLGQLVPERPRPTPVLVPLISPPVSPSSLGSDNTSSHNRPDARDPRSPYDISNTDYFFPR

SEQ ID NO: 419 - protein, 219 aa, Homo sapiens
ESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGEMD

SEQ ID NO: 420 - protein, 25 aa, Homo sapiens
PILLTISILSFFSVALLVILACVLW

SEQ ID NO: 421 - protein, 195 aa, Homo sapiens
KKRIKPIVWPSLPDHKKTLEHLCKKPRKNLNVSFNPESFLDCQIHRVDDIQARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 422 - protein, 522 aa, Homo sapiens
CRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSD

SEQ ID NO: 423 - protein, 25 aa, Homo sapiens
WLIFFASLGSFLSILLVGVLGYLGL

SEQ ID NO: 424 - protein, 92 aa, Homo sapiens
NRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 425 - protein, 175 aa, Homo sapiens
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 426 - protein, 23 aa, Homo sapiens
VAISTSTVLLCGLSAVSLLACYL

SEQ ID NO: 427 - protein, 39 aa, Homo sapiens; identical to SEQ ID NO: 318

SEQ ID NO: 428 - protein, 213 aa, Homo sapiens
CPDLVCYTDYLQTVICILEMWNLHPSTLTLTWQDQYEELKDEATSCSLHRSAHNATHATYTCHMDVFHFMADDIFSVNITDQSGNYSQECGSFLLAESIKPAPPFNVTVTFSGQYNISWRSDYEDPAFYMLKGKLQYELQYRNRGDPWAVSPRRKLISVDSRSVSLLPLEFRKDSSYELQVRAGPMPGSSYQGTWSEWSDPVIFQTQSEELKE

SEQ ID NO: 429 - protein, 21 aa, Homo sapiens
GWNPHLLLLLLLVIVFIPAFW

SEQ ID NO: 430 - protein, 285 aa, Homo sapiens
SLKTHPLWRLWKKIWAVPSPERFFMPLYKGCSGDFKKWVGAPFTGSSLELGPWSPEVPSTLEVYSCHPPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 431 - protein, 332 aa, Homo sapiens
GITNINCSGHIWVEPATIFKMGMNISIYCQAAIKNCQPRKLHFYKNGIKERFQITRINKTTARLWYKNFLEPHASMYCTAECPKHFQETLICGKDISSGYPPDIPDEVTCVIYEYSGNMTCTWNAGKLTYIDTKYVVHVKSLETEEEQQYLTSSYINISTDSLQGGKKYLVWVQAANALGMEESKQLQIHLDDIVIPSAAVISRAETINATVPKTIIYWDSQTTIEKVSCEMRYKATTNQTWNVKEFDTNFTYVQQSEFYLEPNIKYVFQVRCQETGKRYWQPWSSLFFHKTPETVPQVTSKAFQHDTWNSGLTVASISTGHLTSDNRGDIG

SEQ ID NO: 432 - protein, 21 aa, Homo sapiens
LLLGMIVFAVMLSILSLIGIF

SEQ ID NO: 433 - protein, 253 aa, Homo sapiens; identical to SEQ ID NO: 316

SEQ ID NO: 434 - protein, 22 aa, Homo sapiens
MALIVLGGVAGLLLFIGLGIFF

SEQ ID NO: 435 - protein, 40 aa, Homo sapiens
CVRCRHRRRQAERMSQIKRLLSEKKTCQCPHRFQKTCSPI

SEQ ID NO: 436 - protein, 21 aa, Homo sapiens
IYIWAPLAGTCGVLLLSLVIT

SEQ ID NO: 437 - protein, 32 aa, Homo sapiens
LYCNHRNRRRVCKCPRPVVKSGDKPSLSARYV

SEQ ID NO: 438 - protein, 21 aa, Homo sapiens
ILVIFSGMFLVFTLAGALFLH

SEQ ID NO: 439 - protein, 48 aa, Homo sapiens
QRRKYRSNKGESPVEPAEPCHYSCPREEEGSTIPIQEDYRKPEPACSP

SEQ ID NO: 440 - protein, 27 aa, Homo sapiens
FWVLVVVGGVLACYSLLVTVAFIIFWV

SEQ ID NO: 441 - protein, 41 aa, Homo sapiens
RSKRSRLLHSDYMNMTPRRPGPTRKHYQPYAPPRDFAAYRS

SEQ ID NO: 442 - protein, 27 aa, Homo sapiens
IISFFLALTSTALLFLLFFLTLRFSVV

SEQ ID NO: 443 - protein, 42 aa, Homo sapiens; identical to SEQ ID NO: 3

SEQ ID NO: 444 - protein, 21 aa, Homo sapiens
VGVVGGLLGSLVLLVWVLAVI

SEQ ID NO: 445 - protein, 97 aa, Homo sapiens
CSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 446 - protein, 21 aa, Homo sapiens
THLVILGAILLCLGVALTFIF

SEQ ID NO: 447 - protein, 31 aa, Homo sapiens
RLRKGRMMDVKKCGIQDTNSKKQSDTHLEET

SEQ ID NO: 448 - protein, 153 aa, Homo sapiens; identical to SEQ ID NO: 285

SEQ ID NO: 449 - protein, 177 aa, Homo sapiens; identical to SEQ ID NO: 289

SEQ ID NO: 450 - protein, 219 aa, Homo sapiens
MCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 451 - protein, 162 aa, Homo sapiens; identical to SEQ ID NO: 291

SEQ ID NO: 452 - protein, 155 aa, Homo sapiens
MERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 453 - protein, 189 aa, Homo sapiens; identical to SEQ ID NO: 303

SEQ ID NO: 454 - protein, 270 aa, Homo sapiens
MKPKMKYSTNKISTAKWKNTASKALCFKLGKSQQKAKEVCPMYFMKLRSGLMIKKEACYFRRETTKRPSLKTGRKHKRHLVLAACQQQSTVECFAFGISGVQKYTRALHDSSITGISPITEYLASLSTYNDQSITFALEDESYEIYVEDLKKDEKKDKVLLSYYESQHPSNESGDGVDGKMLMVTLSPTKDFWLHANNKEHSVELHKCEKPLPDQAFFVLHNMHSNCVSFECKTDPGVFIGVKDNHLALIKVDSSENLCTENILFKLSET

SEQ ID NO: 455 - protein, 177 aa, Homo sapiens
GPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 456 - protein, 205 aa, Homo sapiens
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 457 - protein, 74 aa, Homo sapiens
GIIQHDLIFSLQQTECVLKPVESSDMKMTQLFTKVESEDTSSLFDKLKKEPDALTLLAPAAGDTIISLDFGSND

SEQ ID NO: 458 - protein, 224 aa, Homo sapiens
SEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQ

SEQ ID NO: 459 - DNA, 750 bp, Homo sapiens
gacatcgtgatgacccagtcccctctgtctttacccgttacacccggtgaacccgccagcattagctgtaggtccaccaagtctttactgcacagcaacggcaacacctatttatactggttcttacagaagcccggccaatccccccagctgctgatctatcgtatgagcaatttagctagcggcgtgcccgacagattcagcggcagcggctccggaaccgacttcactttaaagatctccagagtggaggccgaggacgtgggcgtttactactgcatgcagcatttagagtaccccttcaccttcggcggcggcaccaaggtggagatcaagggtggcggcggcagcggcggcggtggcagcggaggcggaggcagcgagatccagctgcagcaaagcggcgccgaggtgaaaaagcccggcagcagcgtcaaggtgagctgcaaggccagcggctacaccttcaccgattacgacatgcactgggtgagacaagctcccggtcaaggtttagagtggatcggcacaatcgaccccgagaccggcggcacagcctacaaccagaagtttaagggtcgtgccactttaacagccgatcgttccaccagcaccgcctacatggagctgagctctttaaggtccgaggacaccgctgtgtactattgcaccagcttctattacacctacagcaactacgacgtgggctttgcctactggggccaaggtaccctcgtgacagtcagcagc

SEQ ID NO: 460 - DNA, 750 bp, Homo sapiens
gacatcgtgatgacccagagccccctctctttacccgttacacccggtgagcccgctagcatcagctgtcgtagcaccaagtccttattacactccaacggcaacacctatttatactggttcctccagaaacccggccagtccccccagctgctgatctatcgtatgagcaatttagcctccggcgtgcccgatagatttagcggcagcggtagcggcaccgactttactttaaagatctctcgtgtggaggccgaggacgtgggtgtgtactactgcatgcagcatttagagtaccccttcacctttggcggcggcaccaaggtggagatcaaaggcggcggaggaagcggcggcggcggctccggcggcggaggctccgagattcagctccagcagagcggcgccgaggtgaaaaaacccggctcctccgtgaaggtgtcttgtaaggccagcggctacaccttcacagactacgacatgcactgggtgaggcaagctcccggtcaaggactggagtggatgggcaccatcgaccccgaaactggtggcacagcctacaaccagaagttcaagggtcgtgtgaccatcaccgccgataagagcacctccaccgcctacatggagctgagctctttaaggagcgaggacaccgccgtgtattactgcaccagcttctactacacctacagcaactacgacgtgggcttcgcctactggggccaaggtactttagtgaccgtgtccagc

SEQ ID NO: 461 - DNA, 750 bp, Homo sapiens
gacatcgtgatgacccagagccctctgtctttacccgtgacacccggtgagcccgctagcattagctgtcgttccaccaagtctttactgcactccaacggcaacacctatttatactggtatttacagaagcccggccagagcccccagctgctgatctataggatgagcaatttagccagcggcgtgcccgatagattcagcggcagcggaagcggcaccgacttcactttaaagatcagcagagtggaagccgaggacgtgggtgtgtactactgcatgcagcatttagagtaccccttcaccttcggcggcggaaccaaggtggagatcaagggcggcggcggcagcggcggaggaggaagcggaggcggcggctccgagattcagctgcagcaaagcggcgccgaggtgaaaaagcccggtagcagcgtgaaggtgagctgtaaggccagcggctacaccttcaccgactacgatatgcactgggtgaagcaagcccccggtcacggactggagtggatcggcaccattgaccccgagactggtggcaccgcctacaaccagaaattcaagggcaaggccacactgaccgccgatcgttccaccagcacagcctatatggagctgagctctttaaccagcgaggacaccgccgtgtattactgcacctccttttactacacctacagcaactacgacgtgggcttcgcctactggggccaaggtactttagtgaccgtgagctcc

SEQ ID NO: 462 - DNA, 750 bp, Homo sapiens
gacattgtcatgacacagagccctctgtctttacccgttacacccggcgaacccgctagcatcagctgtcgttccaccaaatctttactgcactccaacggcaacacctatttatactggttcttacagaagcccggccaaagcccccagctgctgatttatcgtatgagcaatttagccagcggcgtgcccgatcgtttttccggcagcggcagcggcacagacttcactttaaagatcagcagagtggaggccgaggacgtgggcgtgtactactgcatgcagcacctcgagtacccctttaccttcggcggcggcaccaaagtggagatcaagggaggaggaggatccggcggaggaggaagcggaggcggcggctccgagattcagctgcagcagagcggcgctgaggtgaaaaagcccggcagcagcgtgaaggtgtcttgtaaagcctccggctacaccttcaccgactacgatatgcactgggtgaagcaagctcccggtcaaggtctggagtggatcggcaccatcgatcccgaaaccggcggtaccgcctacaaccagaagttcaaaggcaaggccactttaaccgccgacagaagcacaagcaccgcttacatggagctgtcctctttaagatccgaggacaccgccgtgtattactgcacaagcttctactacacctactccaactacgacgtcggcttcgcctactggggccaaggcactttagtgacagtgagcagc

SEQ ID NO: 463 - DNA, 750 bp, Homo sapiens
gacatcgtgatgacccagagccctctgtctttacccgtgacacccggtgagcccgctagcattagctgtcgttccaccaagtctttactgcactccaacggcaacacctatttatactggttcttacagaagcccggccagagcccccagctgctgatctataggatgagcaatttagccagcggcgtgcccgatagattcagcggcagcggaagcggcaccgacttcactttaaagatcagcagagtggaagccgaggacgtgggtgtgtactactgcatgcagcatttagagtaccccttcaccttcggcggcggaaccaaggtggagatcaagggcggcggcggcagcggcggaggaggaagcggaggcggcggctccgagattcagctgcagcaaagcggcgccgaggtgaaaaagcccggtagcagcgtgaaggtgagctgtaaggccagcggctacaccttcaccgactacgatatgcactgggtgaagcaagcccccggtcacggactggagtggatcggcaccattgaccccgagactggtggcaccgcctacaaccagaaattcaagggcaaggccacactgaccgccgatcgttccaccagcacagcctatatggagctgagctctttaaccagcgaggacaccgccgtgtattactgcacctccttttactacacctacagcaactacgacgtgggcttcgcctactggggccaaggtactttagtgaccgtgagctcc

SEQ ID NO: 464 - DNA, 714 bp, Homo sapiens
agcagcgagctgacccaagatcccgctgtgtccgtggctttaggccagaccgtgaggatcacttgtcgtggcgactctttaaggaagtactacgccagctggtaccagcagaagcccagacaagctcctcagctggtgatctaccacaagaacaacagagccagcggcatccccgatcgtttctccggctccatcagcggcaacaccgcctctttaaccatcaccggagctcaagctgaggacgaagccgcctacttctgcaactctcgtgacaccagcggcaactatttagtgttcggcggaggcaccaaggtgaccgtgctgggaggcggaggaggcagcggcggcggcggctccggaggaggcggctcccagctgcaactgcaagaaagcggacccggtttagtgaaaccctccgagactttatctttaacttgtgctgtgtccggagccagcatcagcaactggtggtcttgggtgagacagccccccggcaaaggactggagtggatcggcgaggtgcaccacagcggcgtgaccacctacaagccctctttaaagtctcgtgtgaccatcagcgtggacaacagcaagaaccagctgtctttaaagctgacaagcgtgaccgccgctgacaccgccgtgtactactgcgccagagagttcgccgatgacgccttcgacatctggggaaggggcaccatggtgaccgtg

SEQ ID NO: 465 - DNA, 750 bp, Homo sapiens
gacatcgtgatgacccagagccccctctctttacccgttacacccggtgagcccgctagcatcagctgtcgtagcaccaagtccttattacactccaacggcaacacctatttatactggtacctccagaaacccggccagtccccccagctgctgatctatcgtatgagcaatttagcctccggcgtgcccgatagatttagcggcagcggtagcggcaccgactttactttaaagatctctcgtgtggaggccgaggacgtgggtgtgtactactgcatgcagcatttagagtaccccttcacctttggcggcggcaccaaggtggagatcaaaggcggcggaggaagcggcggcggcggctccggcggcggaggctccgagattcagctccagcagagcggcgccgaggtgaaaaaacccggctcctccgtgaaggtgtcttgtaaggccagcggctacaccttcacagactacgacatgcactgggtgaggcaagctcccggtcaaggactggagtggatgggcaccatcgaccccgaaactggtggcacagcctacaaccagaagttcaagggtcgtgtgaccatcaccgccgataagagcacctccaccgcctacatggagctgagctctttaaggagcgaggacaccgccgtgtattactgcaccagcttctactacacctacagcaactacgacgtgggcttcgcctactggggccaaggtactttagtgaccgtgtccagc

SEQ ID NO: 466 - DNA, 750 bp, Homo sapiens
gacatcgtgatgacccagtcccctctgtctttacccgttacacccggtgaacccgccagcattagctgtaggtccaccaagtctttactgcacagcaacggcaacacctatttatactggtatttacagaagcccggccaatccccccagctgctgatctatcgtatgagcaatttagctagcggcgtgcccgacagattcagcggcagcggctccggaaccgacttcactttaaagatctccagagtggaggccgaggacgtgggcgtttactactgcatgcagcatttagagtaccccttcaccttcggcggcggcaccaaggtggagatcaagggtggcggcggcagcggcggcggtggcagcggaggcggaggcagcgagatccagctgcagcaaagcggcgccgaggtgaaaaagcccggcagcagcgtcaaggtgagctgcaaggccagcggctacaccttcaccgattacgacatgcactgggtgagacaagctcccggtcaaggtttagagtggatcggcacaatcgaccccgagaccggcggcacagcctacaaccagaagtttaagggtcgtgccactttaacagccgatcgttccaccagcaccgcctacatggagctgagctctttaaggtccgaggacaccgctgtgtactattgcaccagcttctattacacctacagcaactacgacgtgggctttgcctactggggccaaggtaccctcgtgacagtcagcagc

SEQ ID NO: 467 - protein, 10 aa, Artificial Sequence
  Synthesized
GGGGSGGGGS

SEQ ID NO: 468 - protein, 10 aa, Artificial Sequence
  Synthesized
EAAAREAAAR

SEQ ID NO: 469 - DNA, 390 bp, Artificial Sequence
  Synthesized
tcgaggtcgacggtatcgataagcttgatatcgaattaggaggaaaaactgtttcatacagaaggcgtcaattaggaggaaaaactgtttcatacagaaggcgtcaattaggaggaaaaactgtttcatacagaaggcgtcaattggtcccatcgaattaggaggaaaaactgtttcatacagaaggcgtcaattaggaggaaaaactgtttcatacagaaggcgtcaattaggaggaaaaactgtttcatacagaaggcgtcaattggtcccgggacattttgacacccccataatatttttccagaattaacagtataaattgcatctcttgttcaagagttccctatcactctctttaatcactactcacagtaacctcaactcctg

The invention claimed is:

1. A pharmaceutical composition, wherein the pharmaceutical composition comprises modified T cells comprising a first nucleic acid encoding a chimeric antigen receptor (CAR) and a second nucleic acid encoding therapeutic agents IL-6 and IFN-γ and comprising SEQ ID NO: 469.

2. The pharmaceutical composition of claim 1, wherein the modified T cells express and secrete the therapeutic agents IL-6 and IFN-γ in response to activation of the modified T cells.

3. The pharmaceutical composition of claim 1, wherein the modified T cells comprise nucleic acid sequences encoding SEQ ID NOS: 287 and 328.

4. The pharmaceutical composition of claim 1, wherein the CAR comprises an extracellular domain, a transmembrane domain, and an intracellular domain, the extracellular domain binding an antigen.

5. The pharmaceutical composition of claim 4, wherein the intracellular domain comprises a co-stimulatory domain that comprises an intracellular domain of a co-stimulatory molecule selected from the group consisting of CD27, CD28, 4-16B, OX40, CD30, CD40, PD-1, ICOS, lymphocyte function-associated antigen-1 (LFA-1), CD2, CD7, LIGHT, NKG2C, B7-H3, and a combination thereof.

6. The pharmaceutical composition of claim 4, wherein the antigen is CD19.

7. The pharmaceutical composition of claim 1, wherein the therapeutic agents IL-6 and IFN-γ are present in the modified T cells in a recombinant DNA construct, in an mRNA, or in a viral vector.

8. The pharmaceutical composition of claim 1, wherein the modified T cells further comprise a nucleic acid sequence comprising a binding site for a transcription modulator that modulates secretion of therapeutic agents IL-6 or IFN-γ.

9. The pharmaceutical composition of claim 1, wherein SEQ ID NO: 469 drives expression and secretion of the therapeutic agents IL-6 and IFN-γ.

10. The pharmaceutical composition of claim 1, wherein the CAR and the therapeutic agents IL-6 and IFN-γ are produced in the form of a polyprotein, which is cleaved to generate separate CAR and therapeutic agent molecules, and there is a cleavable moiety between the CAR and the therapeutic agents IL-6 and IFN-γ, the cleavable moiety comprising a 2A peptide, and the 2A peptide comprising P2A or T2A.

11. The pharmaceutical composition of claim 1, wherein the modified T cells comprise an additional CAR, and the additional CAR binds a solid tumor antigen.

12. The pharmaceutical composition of claim 11, wherein the solid tumor antigen is TSHR.

13. The pharmaceutical composition of claim 11, wherein the modified T cells comprise a dominant negative PD-1.

14. A method of inducing T cell response in a subject in need thereof, the method comprising administering an effective amount of the pharmaceutical composition of claim 1 to the subject.

* * * * *

UNITED STATES PATENT AND TRADEMARK OFFICE
CERTIFICATE OF CORRECTION

Page 1 of 1

PATENT NO. : 10,918,667 B2
APPLICATION NO. : 16/445965
DATED : February 16, 2021
INVENTOR(S) : Lei Xiao et al.

It is certified that error appears in the above-identified patent and that said Letters Patent is hereby corrected as shown below:

On the Title Page

Item (73) Assignee, change "Innovative Cellular Therapeutics Co., Ltd., Shanghai (CN)"
to --Innovative Cellular Therapeutics Holdings, Ltd., Grand Cayman (KY)--

Signed and Sealed this
Seventh Day of September, 2021

Drew Hirshfeld
*Performing the Functions and Duties of the*
*Under Secretary of Commerce for Intellectual Property and*
*Director of the United States Patent and Trademark Office*